United States Patent 12,577,609 (METHODS FOR CELL-TYPE SPECIFIC PROFILING TO IDENTIFY DRUG TARGETS) - sequence listing, part 5

SEQ ID NO: 4655 - DNA, 1830 bp, Homo sapiens
  ENST00000464187
actcactcatctccaaagcaaagaccccactatccggcaggtcttagggagcagggagaccctgggggtgggggtgagcttccagagaaggggtttcccatgggtttggccatgagattctgctgttgttgatgttcttattatgggaaggctcagacacagcgcagcaaaggtcgtgttctgcctggggccacagggaccagcccacagccaaccccgttccagccagaggccagcccacgcccccgcacccggtgattttgaagccagtccctgacatcagctgcgttcttcgctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctggcccggagcgggaagcagcattagctctaagatacagcatccaagttgtccctgtcacccagtcgtggggcggcacctgccacagttaattaaaccctctgggcttatctggacgtgattaacgagctgttgatggagaacctcatcgccttgacccagccacttgctcatggcctggactaaaatgagctcctctttctgattcagatgagaaagggacgggggatgtagggcagcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgaggtcctcggtccaagacccgcatctacccagccctgctgtctccttagcatccactggtgctttctgtaggatccacctccgctgtctcaggccacctgtgtggcagcccagaccccaccctggcagtgctgaggcagcccctggcagcggaacaccagcaggtgaagggcagaggccccttgtcgtgtcttcagctctgcctgctttgctgagacctcctcttgcccctggaagggacaaggacattgcactctgcatgatctcctgggactgctgcaaccaactgtcacagcccggtggcaaacagcagagatttatcctctcccagctctgggccagaattccaagatcgaggtgtgggcggggccgtgctccctctgaagcttccagcgggggactctgcctgccgcttccagccccgggtggccccagacactccttggcttgtggccacgtcgccccagcttctgcctccgtctttacacagcctctctcttccccctgtgtctctctgtgtgacccacaaggacatttgtcgttggatttagggcccatcctaatctaggatgttcccatttccagatccttcattccatctgcagtgatcttatttctggacaaggtcacctgtggatctagattctgggagttccgacctggacccatccctcggggccatgattcagccacttccctacaccagcgtggaaaaggggtttttcgtctcttaaattgccacagagcacgtgtgctt

SEQ ID NO: 4656 - DNA, 670 bp, Homo sapiens
  ENST00000469093
acgaccccaccagctccccgtcggagatcgggccgggaatgccggcgaaccaggataccatctatgaagggattggaggacctcggggcgagaaaggccaaaagggagaaccagcgattatcgagccggtgaggacattttctcattccctccctgcgccggggtgtccgctgctcggggtcacagcggggtgtgtagggtgtgaacaggtccgtgggcccctgcacctgcgcgcactgggtcacttcgagcaaccacctggtctcgtggagtccacgcaccacttgtccccaggacttgtgaagaatccccttgggtaggggatgttctggactgtgatggagggggcgggataggtgctgatcaaagccggtcctgcacccaagctctgggcatctcagtgctggtcagtttcacctgggatgaaaagcagctcagagctatcgaggcggaggcggagtcccctttgaggggtggaggagaggatgtaaatggcccattccgtgtaaaagatgcgcgcggcagtggtagggaatagttaacacgtggtcgtacctctctgcgtctgttatgcaaccgtttggagtaagtttacagaagctgttgaaacatggaatactgtttatgaaactttatcaagggaatgaaataaaacagcactgtgctgaaa

SEQ ID NO: 4657 - DNA, 533 bp, Homo sapiens
  ENST00000463925
agtgtggattaattgaagcgatgcaccagaagttcatggtccaggggcgggctcagagtcggccctcagtggccctggctgaaatccattaggactgtggggacggtcaccctcaccaactcccacttcctgccagcggatccctctcttgggtaatgagctggtggggggatgttcccaggttggagccacgtttgacctgagatcttctgtattctctagggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacaggtaagtattggcacgggggcgcgcggcagcccccaggtcccggggggcctcgtcgcaggctgtaggccgtgtgccatgcacgttctcttccaacgttgctgatgactagcgggacatgctgtgaaaatctcccgtgcatgtgtgttccc

SEQ ID NO: 4658 - DNA, 913 bp, Homo sapiens
  ENST00000460264
ctgggcaggacatggagcacggtggggctggagctgagacccggcttgctgacgttctgccctcctctctctgcagggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactggtaaggtggcctctggcgtctttgcggttgtcactttaaacccgcccatctcgtatcttacagagtaaaatggcccgctggcccaaagagcagccttccacctggtatagtcagtacaagcgggggtccctggtaagtggccacctcggcccggccacctcggcactgcctgcttgcggcacggctggctcgcggctctgcatggcacccatcgctgccatgtgtgccacaccgctcttgccaaaccgctccacatcacgtgacagcaagactcagctaggtgtggagtcctctccccagcccccgcca

SEQ ID NO: 4659 - DNA, 628 bp, Homo sapiens
  ENST00000371820
caggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaagggagtaaaatggcccgctggcccaaagagcagccttccacctggtatagtcagtacaagcgggggtccctgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgct

SEQ ID NO: 4660 - DNA, 583 bp, Homo sapiens
  ENST00000465877
catggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactggtaaggtggcctctggcgtctttgcggttgtcactttaaacccgcccatctcgtatcttacagagtaaaatggcccgctggcccaaagagcagccttccacctggtatagtcagtacaagcgggggtccctggtttgcccgtaaggttctcgtggctgcgtctgaaagcgtggagttcgccgatagccctgggactgcagcgtgttccctcgcccctgggaaggcccaggccccaggccagctgctcactttgggctttttctagtg

SEQ ID NO: 4661 - DNA, 8437 bp, Homo sapiens
  ENST00000618395
ccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctggggagcccgggccacgtggtctgcttgggccgaaggggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaagggagtaaaatggcccgctggcccaaagagcagccttccacctggtatagtcagtacaagcgggggtccctgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgaccctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctatctgttttaaggtctccttgaaggcgcactggggaccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaattcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacggtttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgt

SEQ ID NO: 4662 - DNA, 6174 bp, Homo sapiens
  ENST00000264828
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagagaggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcccgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggggtccatgggcccccgtggagacactggacctgcaggcccaccaggccccccgggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggggaatactggattgaccccaaccagggctgcgcgcgggactcgttcagggttttttgcaacttcacggcgggaggagagacctgcctctatcccgacaagaagtttgagatcgtgaaattggcctcctggtccaaggaaaagcctggaggctggtatagcacattccgtcgagggaagaagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccggctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccatgagggagccccagaatggggtgcatttggtgctgaggctttgaagccaccgtatttttcgttacctgtgactatggagccaatgggatgtgacttcgctcatcacggacagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgccccccacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcctggccccccaccgccaggccatagggcataatttgcatctcaaatctgagaataaactgatgaactgtg

SEQ ID NO: 4663 - DNA, 828 bp, Homo sapiens
  ENST00000461214
atcccaccttggtggcctactctgaccatcccttgacctcatccctggtaattcccatttgaaatctgcataatttcccatttgaccatcccctaaccacccacacagacctcgagttcacatttgagaatccctaactgacccttgctcttctcccaggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcggtgagtatgcagggaatcttttgtgggatgaggtcactgtggtggtccaggccaggacctcagctctccctgtctgtaccctacagggccctctaggacagaaaggctcaaaagggtctccggtgagtacaccctgcttccgtgggcttacacatcccagctccccacccccttcactgcaccagaaccctccacgtctctgccttcatttatttatttattcatgcaatcgtgcgttcgacaaatatttattcaacacctacggttgtatttcatcagatccaaaatgccatcaattataagatgtaccattattttacaaactgctaggaaagaaaacagttctgccaagtaaactatgacttgccaaagatgttaagaagctgatttcagagacattaaaacatgaaaagaaaatttgtgtctgatgcctaatgctgaaaactgcatgtc

SEQ ID NO: 4664 - DNA, 4238 bp, Homo sapiens
  ENST00000361866
tccttgccctccgctctcactctggctgggagcagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 4665 - DNA, 435 bp, Homo sapiens
  ENST00000492851
cggccgcaggtggaaagtaattctgcgtttccatttctctttccagaaaaataacgtggagcaagtggtaagagccctccccaccacccccagccgtgagtctgcacacgtccacccacacgtccacctgtgtgttcaggacgcatgtccctatgcatatccgcccatgtgcccgggacacatgtcccctgcgtgtctgcccgtgtgcccgggatgtgtgtccccctgcgtgtccacctgtgtgtctgcccatgtgcctgggacatgtgtccgcctgtgcgtccatccgtgtgtccgtctgcccatgtgcctgggtcgcatgtcaccctgtgtcccagccgtatgtccgtggctttcccactgactcgtctccatgctttccccccacagtgctgctccttcgaatgccagcctgcaagaggacctccggggctc

SEQ ID NO: 4666 - DNA, 500 bp, Homo sapiens
  ENST00000466285
gggcagcagagccgagcccagggacacagcgggtcctcagggtggggcccacctgggatggccgcctggaccaccagtgtgcgaagccccagctgccctcacagcaccgtcactggaggacgaggggctgggtagggagggaccgggcaggggtgggcttgatgaggggcagggccctgggggtgggggctgtctcagctcaggaagcacagtgggctcctcaccctcagagctcctctactccgtttctcggacagggacccccaggacaccaaggaccgcctgggccggacgaatgcgagattttggacatcatcatgaaaatgtgctcttgctgtggtgagacccaggctctagctcctgagagaatggatcccgggggtcggggagcgaggcctgggtcccacacatgtcacaggacagcacatggcactctggtccccgcccgcagctccctgcacctgcccgccccctctggggcctgctccaagccagcaggg

SEQ ID NO: 4667 - DNA, 863 bp, Homo sapiens
  ENST00000463060
cccgggtgttgggctgggccccgccctctttcacccataactgaaataaccaggagcaggcttgggggggtccctgctccatcattctggcccacaggccccaccctagcctggctgagcaacgccagccctgaccagccgccggacagagcagcctttacggggccatgggagggggtgggcttttctggggctgagacggggggaccccaacgtgtcagaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgcccca

SEQ ID NO: 4668 - DNA, 2358 bp, Homo sapiens
  ENST00000498614
gggccagggcactggaggggaggggcgtgctctgctgacaccgcccccgcctgcagaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 4669 - DNA, 968 bp, Homo sapiens
  ENST00000486023
agcaggctgcgccacaccgatactgtctgtccccacaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaa

SEQ ID NO: 4670 - DNA, 3251 bp, Homo sapiens
  ENST00000612273
cagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccg

SEQ ID NO: 4671 - DNA, 4761 bp, Homo sapiens
  ENST00000357250
cctttgcttttagccctcaccgggggcaggagggaccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttctataggtgtatgtttataatattagtgttttttctacataaagtaatttaaaaagctgttccacagagggtgttaccctgtgacagatgcgtatgtgtgtgtgtgtgtgtgtgtgtgtgttttagtgtgtatggagagagcttcatggaccttttcgaaatgttaattccctagaaagatgtgcagctgcatgcgcatctatatttttgtatagtatttcagagatttcgtggacttttttaagtctagccttgctttatttctaggttaagaaccactgccttcattccaatggcttgttagctccctcctactcagaactttattgtaaacatgatttatgtttcaccatttcttgtaaattttataaatgcagctcagctaaagcactgtattcttaacaagtatttcctgaccacttaagcactttattattatctgtgtaatcatattggcttgctgtttcattaacatctacttaactatccaacagacttaatatattcattttatatcacagagcctgtgagtaacctgtgctggggcataaaacaatagctcaacatagtatctttagttagtttatggaactaaattctgtcaagtcaaaggagagtgagccctaatataattttttatatatatttttctcgtgtgtacttttatacattttaaattctagtcctagttgtttggttaaatcaatcattatgtaatctgtatttggatttctttaaaactgcttacagcatctagttttatgcttctagcatgaattttgcttaagaagattccaactttgccatatagatcagtgctatttacatagactgaaagaatgttctttcccttttttcaaatatgacttttgaaaataaaggtctctgttatagctccctaaaacaatccttaaaaaaatggcaaactttttcaggagctgtgacacataattaaataaaggcatagaaatta

SEQ ID NO: 4672 - DNA, 3059 bp, Homo sapiens
  ENST00000320755
cgcgcgcctcccgggcctggacgctttggcaaccgctactcccgggggtgctttttctgcagggacgaagtgccacctatgctagtggcgggtctggaagcctagaggggaaccaggctgcagagccgggccaagggattagcggcgggcggcgggcatggcctggactgcgcgggaccgcggggccctggggctgctgctgttggggctctgcttgtgcgcggctcaaagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgatggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggtgaccctgggagaagaggaccacctggcccccctggccccccaggacccagaggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaagaagaaataaatatggtttcttaatctcttgcatgttttcttataaataatcatgttcaatgaaaagaagttactgagcttatttagatacattaaacattacttaactactggttct

SEQ ID NO: 4673 - DNA, 1844 bp, Homo sapiens
  ENST00000486080
actgcaacctccatctcccagtttcaagaaattctcccccctcagcctcccgagtagttgggattacaggcgcccgccatgatgcctagctaatttttgtagagacaggggtttgaccatgttggccaggctggtcccaaactcttgacctcaggtgatccgtccgcatcagcctcttaaagtgctgggattataaggcatgagcccctgcgcctagccctgaatggcttcttaaaaagagatgagttggcagatgtgtctcaatttgttggggacgtatgtggcagcacagagcatccaagagaaatgtacagcctttggttatggttcatcattatttttggtttttgggatggagtctaacttttttgcctaggctggggtgcagtggcgcgatcttgggtcactgcaacctccacctcccgggttcaagtgatgctcctgcctcagcctcctgagtagctgggagtacaggcacctgccaccacgccaagctaatttttgtatgtttagtagagacggggtttcaccatgttggtcgggctggtctcgaactcctgatctcaagtgatccacccacctcggcctcccaaagtgctgggattacaggtgtgaaccaccatgcgcggccaattcatcatttttaatgggcagtagaggagaattaggaccagtgggatccccaggcctaccaggtaaactgggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatcacatatagaagaacggtgctattcagtaagttctctttcctttcccttggagggaagacagcagagtcatcagttaaaaaaaaaaaaagaaaaccaaacacctcccttgaataaatttatactcctgttcccaggatcttgagctttagtgtgctatacctatgtgtcttatcgtgggccactgtgccaataaacaaaaacaactgtttggtttacctc

SEQ ID NO: 4674 - DNA, 1940 bp, Homo sapiens
  ENST00000489611
aatagattgtactggcttcggcttacctgctgtgagcccactggcaggctcctggaagctagccttcgcccttgctctttcaccggcactccctgcattaatttagaaaaagatcctgcagggattaacaggacctgatggatcccctggctccattgggtcaaagggacaaaaaggagaacctggtgtgcctggatcgcgtggatttccaggccgtggtattcctggaccccctggtcctcctgggacagcaggactccctggagagcttggccgtgtaggacctgttggaacaattggctttcatgatggagatccattgtgtcccaatgcctgtccaccaggtcgctcaggatatccaggcctaccaggcatgaggggtcataaaggggctaaaggagaaattggtgaaccaggaagacaaggacacaagggtgaagaaggtgaccagggagaactcggagaagttggagctcaaggacctccaggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcaggtttgcatgagagtcatacaagaacattttgctgagatggctgccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgacttgggagaaaagggggagcgtggccctccaggaagaggtcccaacggtttgcctggagctataggtctcccaggtgacccaggccctgccagctatggcagaaatggccgagacggtgagcgaggccccccaggggtggcaggaattcctggagtgcctggacccccgggacctcctgggcttcccggtttctgtgagccagcctcctgcaccatgcaggctggtcagcgagcatttaacaaagggcctgacccttgaaaggcttactgctgcatggctgtctgcatgaaccacgcctggtgaaggagcctgggtgagaaacaccatccaaagctggggcaaagatgattaccttcagcatgattacaatgtattaccttcagtatgattacagaagtcctacttgacaatc

SEQ ID NO: 4675 - DNA, 690 bp, Homo sapiens
  ENST00000447041
aattgccctgttgatgaaaggtgaaccaggaaaacctgggcctcctggtgatgcaggattgcaggggttaccaggtgtacctggaattcctggtgcaaagggtgttgctggtgaaaagcatgtgttttattttatatttggccctagggagaaataaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagggcctgagggaagtcgggggcttcctggagtggaaggaccaagaggaccacctggaccccggggtgtgcagggagaacagggtgccaccggcctgcctggtgtccagggccctccgggtagagcaccgacagatcagcacattaagcagg

SEQ ID NO: 4676 - DNA, 1117 bp, Homo sapiens
  ENST00000493682
atgtaaccaggttacatgccatgaaggaagtgggaatgatagtgtaagttctacatacaagttaaaaggtaagtcaaacatattatcacaatttctcttatgctggtatttactttttttgtcataagtgattttgtcaactccagttttgtgtaagacttcagaattttataaaaaggtttaccatcagaagaattctccttggactttctaaactagaaatgtttgtctatatatatatagttactatttcttggtattacctttggttatgataatatccattgtctagatcagcttttgtgatgagatttttaaaaatctttgcttcaactaaaataattcacttctctttttcacatttccagggagcccagggtttgcgaggcatcaccggcatagttggggacaaaggggaaaaaggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaaggtgaagcaggagaaaggggggaacttggagatataggattacctggcccaaagggatctgcaggtaatcctggggaacctggcttgagagg

SEQ ID NO: 4677 - DNA, 699 bp, Homo sapiens
  ENST00000360859
cgtctataatgcaaaggctgggttctgctcttgtaatgcaaggtgaatgataaattcaaggtctttttcaggtcttcaaaatctcttcttctctgggtgctcggggcttagatggtgaacctgggcctcagggtcttcctggtgcacctggtgatcaaggacagcgaggacctccaggagaagcaggtcccaaaggagatagaggggctgaaggtgctagaggaattcctggtctccctgggcccaaaggagacacgggtttgccaggtgtggatggccgtgatgggatccctggaatgcctggaacaaagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaacaggggcctccaggagaggtgggaccccgaggaccccaggggcttcctggcagtagaggagaattaggaccagtgggatccccaggcctaccaggtaaactgggttctctgggtagccctggcctccctggcttgcctgggccccctggacttcctggaatgaaaggtgacaggggtgtagtcggtgaaccgggtccaaagggtgaacagggtgcctctggtgaagaag

SEQ ID NO: 4678 - DNA, 243 bp, Homo sapiens
  ENST00000489861
aaacgtctgtgctcctccgtttcttaaaagaaatacagcagctcatacaggttcaatcatgtgataaaagctttttttgcagggtgaaccaggaaaacctgggcctcctggtgatgcaggattgcaggggttaccaggtgtacctggaattcctggtgcaaagggtgttgctggtgaaaagggtagcacaggtgctccagggaagcctggtcagatgggaaattcaggcaaaccgggccaaca

SEQ ID NO: 4679 - DNA, 531 bp, Homo sapiens
  ENST00000470652
gtatttttgtttcataaatgaagtaaaggaggtaaataaacctgagtaaatggcagaaccaagacccaccagtcttagctattacaacattgtaattgctatgttgcatttttttccaaagcagagacaaaaaacactgaattattgaaccctgtgataaacaatgcagttagcaggaagttaggagtatgatacaacttatcaagaagaaataatcacaacaggcagatcttctgttaatctttacttttgagtaagactatagtaaggtatttctttataaatatttgcatcatacttatgtaaccatcctgtagacaattaataaataaaatgaaagttttctacttagtggtttgcctaaggatgttatgatagttctaacatcattgtcttgctctattagggattaacaggacctgatggatcccctggctccattgggtcaaagggacaaaaaggagaacctggtgtgcctggatcgcgtggatttccagtaagtaaatgtaaagctacagaattgaaaatttc

SEQ ID NO: 4680 - DNA, 1372 bp, Homo sapiens
  ENST00000370496
ccctcaccgggggcaggagggaccaaggctgggcccagaacacatagtcctagggtaacagtgaaggggtcgtgaggggacagtgactcccttccaaccccttcttcatagggactgttggcaaacaaagaaaatcaactgggaaaatgaagacctgctggaaaattccagttttcttctttgtgtgcagtttcctggaaccctgggcatctgcagctgtcaagcgtcgccccagattccctgtcaattccaattctaatggtggaaatgaactctgtccaaagatcaggattggccaagatgacttaccagggtttgatctgatctctcagttccaggtagataaagcagcatctagaagagctatccagagagtagtgggatcagctacattgcaggtggcttacaagttgggaaataatgtagacttcaggattccaactaggaatttatatcccagtggactgcctgaagaatactccttcttgacgacgtttcgaatgactggaagcactctcaaaaagaactggaacatttggcagattcaggattcctctgggaaggagcaagttggcataaagattaatggccaaacacaatctgttgtattttcatacaagggactggatggaagtctccaaacagcagccttttcgaatttgtcctccttgtttgattcccagtggcataagatcatgattggcgtggagaggagtagtgctactctttttgttgactgcaacaggattgaatctttacctataaagccaagaggcccaattgacattgatggctttgctgtgctgggaaaacttgcagataatcctcaagtttctgttccatttgaacttcaatggatgctgatccattgtgaccccctgcggcccaggagagaaacttgccatgagctgccagccagaataacgcccagccagaccaccgacgagagaggtcccccgggtgagcagggtcctcccgggcctccgggcccccctggagttccaggcatcgatggcatcgacggtgaccgaggtcctaagggccccccgggccccccgggtcctgcaggtgaaccgggaaagccaggagctccaggcaagcctggcacacctggcgctgataccagtccttgattttgtccctggaatatgaagtgaagtaagaaatggcgtctgttcttagcataccatggtgcatcactcaagttactcttcaagttaccactttatgtgttttccaaaaactaaagacttttctaaatgaaagaaagcactcgaaaacctataattatgatttccaagaatttttgactacagtttaagacatatccttcattttgaaagaaaaataaataactggatttttactgtta

SEQ ID NO: 4681 - DNA, 492 bp, Homo sapiens
  ENST00000580242
ttttctttagaaggaagggcccttcttaatagcacactgaataaaatcaaatgaataatcacacattacaagatgcctcctatacgtctctatatttagctacttacataccaggtttcttttttgtttgtttttgtttttaagacagagtctcgctctgtcacccaggctggagtgcggtggcgcgatctcggctcactgcaatctctgcctcccaggttcaagcgactctcccgcctcagcctctgcagtagcttagggactacaggtgtgagccaccgtgcccggcctacacaccagctttctattcacctacacacaactgatgctcttttggagtggagagttttagtaaaatatgatggggtcttcaggcacctgagttgctacttactactatgagaagatagaaaatgttttttcctctaaacagcttttgaaagaatgaatgcacaacaaggcaaaaaataaaaactttcttttccttttcta

SEQ ID NO: 4682 - DNA, 5742 bp, Homo sapiens
  ENST00000400256
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggctccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccagcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtgtatatatatatatatatatatatttttttttttttttttttttaatgtttcatttcctcagaggaaccaatcacttggaatgtctagaaatatccttgcagattttgccagtgtcaatcaagcctgcacacatgcacagtgaagcgggctgtgcctgccttgagcccatcaccagccaacattcttgacgtgtgcctgaccagacacagaagaaatgggcaactcaagacgtgcttccacttcattttggtggagtcgggaggtgtgggggatggagaggcatctgttgggaagggcactgaatctggcctatctggaaggccctgtgtcatggctgagctatgactgtacttggcatcagatccctacagagccaacattaactgtcaggaacgtatggcgtcacatcagccaaaggcagagatgctagaaagatgggaaccggctacgtgttacctggaaagtttgttttcttaagtcatattccaaaaacataactccaaggcatacgcatgataaaatgcaagaataaacttttggccactttgtggaactcttaaaagaacctttccagccgggcgcagtggctcatgcctgtaatcccagcactttgggaggccgaggcaggcagatgacttgaggtcaggagttcgagaccagcctggccaacgtggcaaaaccccatctctactaaaaataagaaaattagccgggtgtagtggcacatgcctgtaatcccagctactcaggaggctgaggcaggagaatcgcttgagcccaggaggcagagattgcagtgagccaagatcgcaccactgcactccagcctcggtgacagagcaagactccatctcaaaaaaaaaaaaaaaaaaaaaacctttcctctgagcccatcttcctttcgctccttgactttccttgacttgctgttggaaagtctaatatgaaaagggctgaaactaggcattaaatataactgatgctcaaaggtaagatttccatccaacagattccttctccctcccaagggtcttcccaggcagtgctgctacttatcccaaataaaatggtaaaagaataaagacagccgggcgcggtggctcacgcctgtaatcccagcactttgggaggccgaggcggacggatcacaaggtcaggagatcgagaccatcctggctaacacggtgaaaccccgtctctactaaaaatacaaaaaaaaaattagccgggcgcggtggcgggcgcctgtagtcccagctactcgggaggctgaggcaggagaatggcgtgaacccaggaagcggagcttgcagtgagccgagatcgcgccactgcactccagcctgggcgacagagcgagactcatctcaaaaagaaaaaaaaaaaagaataaagacagagtttgactttcccacctgcgaacaagtggactgtactgctttgcccacagtctccattccccattcatgctgttttcacagcccagtaatggccaactgctcagcacctgtgtgccctgctgtcaggcaggtgggacccacagtcctctgggcctaaactgctgaagcctgcaccacaaggcgggcacggcattccaacacctcttcaggctcaacagcctttagaggctacactgagtcctctttttcatgctcttcctggttttcaagtgtcaattaaaatttgtcttcagaagaaacttgaaaataagtatctgatgccgtcatcaggatagactagtattagctttcgcagctgaagttattgctctcccagccctaataataacttaccaagtgcttattatttatcaggcactggtccaagtccttcaatcagattgtctcacctgatcctcccaacagccctaggaagcaggtcttactacactccccatttcacagggactggggcttggggaggtgatgcggtttcctgggtcactccattactgagtagtgagacaggattcagacgcaagctttgaaaatgttctaattttctttagaaggaagggcccttcttaatagcacactgaataaaatcaaatgaataatcacacattacaagatgcctcctatacgtctctatatttagctacttacataccaggtttcttttttgtttgtttttgtttttaagacagagtctcgctctgtcacccaggctggagtgcggtggcgcgatctcggctcactgcaatctctgcctcccaggttcaagcgactctcccgcctcagcctctgcagtagcttagggactacaggtgcgtgccaccatgccaggctaatttttgtgtttttagtagagacacggtttcgccattttggccaggctggtctcaaactcctgacctcaggtgatccacccgccttggcctcccaaagtgctgggattacaggtgtgagccaccgtgcccggcctacacaccagctttctattcacctacacacaactgatgctcttttggagtggagagttttagtaaaatatgatggggtcttcaggcacctgagttgctacttactactatgagaagatagaaaatgttttttcctctaaacagcttttgaaagaatgaatgcacaacaaggcaaaaaataaaaactttcttttccttttcta

SEQ ID NO: 4683 - DNA, 4719 bp, Homo sapiens
  ENST00000582147
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggctccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccagcaccggaggacaatggtaagtccaagccctccctccagccagggggacagggcagtgcatgtgcttgagactgagccaacccccagtgtgtggccccacccatgttatttttgtttttgtttttgttttgagacagggtctcactctgttgcccaggctggagtgcagtggcgtgatctcggctcactgcaacctccacatcccgggttcaagtgattctcctgccttagcctcccaggtagctgggactacaagcgtgtgcccccacagccagctaatttttgtatttttagtagagagggggtttcaccgtgttggccaggctggtctcaaactcctggcctcaagtgatccacctaccttagtctcccaaagtgctgggattacaggtgtgagccaccacgtcttgtcccccgctgcatattatttaacagcaaaggcatcataggggctggcacaggagccctgctgccagaacaggcctccataccaggcatgtgtttctctctaaacgccattgggttctctagtgctcatttgttttatgtattatgtgtgtatgtatgggacagggtctcactctgtcacccaggctggaatgacgaagtgaagtagtgcaaacatagctcactgcagctttgacctcctgggcttaggtgatcttcccactcagactcctgcgtagctgggaccacaggggtatgccaccacacctggctaattttttattttcctttttgtagagacagggtcttgctatgttgcccaggctggtcttgaactcctggcctcaagcaaccctcctgcctcagtcttgcaaagtgctgggattccaggtgggagccactgcacctggctcttgcacttgtttatttataggagccagccctcagaagacaaacacaatgcaaaacatttccttcagggaagcctgctggccgccctgagcgctcttccctcgttttacatcctcactctggagatagatgggctccctcggttagctccatcaacatgtggatggaaccctctgctattgatgactacatttaatttctttttgagaaaggtgttagatgttacggtgccttctagtcttttgataattaaacctttggcaaaactcgaatgtttggttagcaaccaagcctatttttctctcctttgacccaaccgctattctacttgattttggtcggtgaggcccgggttatttttgttgatccgtgagcccagttttggtgctgggttctcacatccaagtgttcctgggttccgtatgattccagactgacgctgaacatctgtgcctgccctgcttcttgttgttgcttctgttatttctgtcattgtgaagacggatccagacacagaagaacaaagacccagtcaaagatcttttccagattatgtggttttggcttgtgctctgcagtccactttgggtcatgcttgctgcgagcacgtccgtgaacgtcagctgtgggcctcgtgcagggacgctcaggctgctcccagcgggaccacagttttggcctctgaaacacagctgaagaaaggcagagtgctttctgtgatcttttaatcaatgttttccacttttgcattcctaggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtgtata

SEQ ID NO: 4684 - DNA, 587 bp, Homo sapiens
  ENST00000486375
tggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtcctcctctcaagtcctcactgccatctcttccaaacactttctgatgactgccaacggtgaacaaacccgtgcaccctaggagaaggcattacccctctgtggcagaggtggtcgtgttcatcaactcctccaggtttctcctgcatttcccacctcccctgtactcacatcgggcccggggactggttgatgggctgtgaacagaagtgacaggtgtcgctttggtctaaggcagttgggaacagtttgtgagttctctttactctctttatcatcactgtgactggaagggaaacaccgagatggcgaagttgcaagatggaagctgcctggatctgtgagctgctgttagagaaaagctactaaggagtttcctggcttgcattacactgtcccgtgaaagaaaaaataaacctcggtcttaagctgttgaaa

SEQ ID NO: 4685 - DNA, 4723 bp, Homo sapiens
  ENST00000367521
ttttctattcttttactttcaacctatttttgtcttttaatctaaaggctgcctcttatagataccacatggttgtattaatttttaaaacttactatgccaaattcttccttcattgcagtgttttattcatttgccttcactacatttttttccagatccttaaggtcagccagaggtgagagactagggacttctcaagtttttcctgggcgtgtggacagccctgaatatgcctggggccttctagattctcagggatattttggagcaaatcaaactccctatggacctcttattccttggtttttccttttaagttttttggtgggcttcttgttagcatcagctgataatgcttctcaaacagctgtaatgttaaacagttgttgctcatgggttttgacaaatgacctgcagatagtgctgttcacagaaaatgaactctgagtcaggtcaaatcaagacaagctctgagaatgtagcttttcaaggagctactagacaggttgaatagagattattttctgggggcaggtctttaagggagtctcagtccattttgtccctgccagtggcttctgggttggtggggtttgccgctctcttagttgtgaggctactggttttcaaggcttttgtagggctggggtgaacaggttaggattagggcagctgtgaacttcacaaagctcactgtgttaacagagattcagcagtaggtcttgatcaaacactccttggattattgcagtactttaactaatttccataggagtgtacttattaaatcttgtcaaaaaactgatgatgcttagaactatgttgggcactatgagggatacacaaaaatatgataccctcttgtcttcccagacctcataatactagtgtgacacattagcctggaggaacttctaaggaataaagggaagcctctctgtctttgtctgtgtgggggaggggtgtttgcagaactaactctctctttctctggcctttgtggtggggacctttgacttgttaatctccagacgtgttttatgtgatgcagggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttccttcccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctc

SEQ ID NO: 4686 - DNA, 5177 bp, Homo sapiens
  ENST00000361927
cacaactcgcggctctagggaaggccacagacctcagctgtacgagcggaacctggactagaggaactttcctcaggactcagggcacacagcccctcggccactactgtctgcgagcccgaggcgcaggggagcgccagcggctgcaggtacgctgcgcacccgcactggggcctgggcggtgcagcggcggcgggagggtcctgggaaccgcagccgccgaggccagtgtgtgagccggccggccgcggcaagccgcatcccccggccgcccctcgcagccccttgctccccggcagccgccgccgccctcaggcagcccagccgggcgctcgcgccaggacttccccgccgcccgcctcggcccggaacatggctgcgcgccctgctgccaccctcgcctggtcgctactgctcctctcctcagccctgctccgcgaaggctgccgagcgcgcttcgtcgccgagcgggactcggaggacgacggagaggagccggtggttttcccggagtcgcccctgcagagccccacggtgctcgtggcggtcctcgcccgcaacgcggcgcacacgctgccgcacttcctcggctgcctggagcggctggactaccccaagagcaggatggccatctgggcagccactgatcacaatgtggataatacaacagaaatattcagggagtggttgaaaaatgtacagagactctatcactatgtggagtggaggcctatggatgaaccagagtcttaccctgatgaaattggaccaaagcactggccaacctcccggtttgcccatgtgatgaaactacgacaggcagcccttcgaactgcgagggaaaaatggtcagactacattctgttcatagatgttgacaatttcctgactaatccacagaccctcaatctactgattgcagaaaacaaaactattgtggcccccatgctggagtctcggggcctgtattctaatttctggtgcggaatcacccctaagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgccttctccagcaggcaagcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttccttcccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctc

SEQ ID NO: 4687 - DNA, 2325 bp, Homo sapiens
  ENST00000367520
ttttcgtttttttgttctatgtatgcctagatttagctttaataatctgtcagcgttacagaattttcctgtttgctttcatatcaaatgtggatttcattcctcattttcttgttatttcctgtaggtggattacagtgttccattctgctctccagaatgggaattccttgcctcccttttgatcctttcatgccttttttgttcattccaggccatgagtttgctttttcttcagagggaaaaaatcaatttcctctgggctgaagaatagccgagtgtttttattagtccccaatgctgtgttttacttttttaataaaggagcattttttaggtctatagacatacctgaaacaaccacttatttaattgcagtgtcaaactcagcatcagacacagttcaggttccttctcctcgcttgtcactcagcagtatgttttctgattgttggctttgtccctctcttggatcctcaggcatccagatgtacctctgcaacagagagcactatggctacctgcccatccccctgaagccccatcagacactgcaggaagacatcgagaacctcatccatgtgcagattgaagcaatgattgaccgtcctccaatggaaccctcccagtatgtctcagttgtccctaaatatccagacaagatgggatttgatgagattttcatgataaacctcaaacgcagaaaggacaggcgggaccggatgctgcgcacactgtatgaacaggagattgaggtcaagattgtcgaggctgtggatggaaaggcactcaacacaagccagctgaaggcactgaatattgaaatgctgcctggctatcgagatccctattcctccaggcctctaacaaggggtgaaatcggctgctttctcagccactactcagtctggaaagaggtaattgatcgagagctagagaagactcttgtaattgaagacgatgtgcgttttgagcatcagtttaagaagaagctgatgaagctgatggataacattgaccaggctcagctggactgggaactgatttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatat

SEQ ID NO: 4688 - DNA, 587 bp, Homo sapiens; identical to SEQ ID NO: 4684
  ENST00000486375

SEQ ID NO: 4689 - DNA, 4723 bp, Homo sapiens; identical to SEQ ID NO: 4685
  ENST00000367521

SEQ ID NO: 4690 - DNA, 5177 bp, Homo sapiens; identical to SEQ ID NO: 4686
  ENST00000361927

SEQ ID NO: 4691 - DNA, 2325 bp, Homo sapiens; identical to SEQ ID NO: 4687
  ENST00000367520

SEQ ID NO: 4692 - DNA, 2239 bp, Homo sapiens
  ENST00000263960
aagaaggggcgtgtcaggctgcgcaggcggccagtccattggctggaagagaccggagccgggctccgggcccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgtacagttagtttggttattgaaatcttcctatattgtttaaatgtgtatttgcatagacatagtaaagtgttacagcatttcatgtcttaaaaatatctatgaagatatctaaaatatctatttctatgaagaaacagactttaacaaatataagcaaaattcagttttcttttaaccagt

SEQ ID NO: 4693 - DNA, 879 bp, Homo sapiens
  ENST00000409398
cccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatc

SEQ ID NO: 4694 - DNA, 549 bp, Homo sapiens
  ENST00000488445
gtgcatttccgtgtctttagaggagaaggcttttttttgcgtttggcatctgagggactcaagagcggcgcgcatcaccttgggcccaaggctgtgttcgtggctcgtttgcctcgtgagaggcggtgaatcatcggcgaagcgactttggaagcaatttggccattggtgcctttgggctcttccggtctcctcccctatggcttgttgctactgctgttggaaagttttaactttgcgcagaagggttgccggctgctggctgtatgggagtttgtgtttggcggtgagcccccttctccggttccttctacctgccagatggtcagatgcgttttcccaatttctgaaagagtgctttgccctcgccatttagtgtttacaaaactaaatacagccagcataagggacttggattttttcactctgctgtaacttacaggtcctgtaaccttgaagcatagtcagctttcgattttcctgatatttagcttcctgtggtatactgatgagcagaactcttccactacatacctcaattttgcctaa

SEQ ID NO: 4695 - DNA, 1355 bp, Homo sapiens
  ENST00000409010
ttttttttgcgtttggcatctgagggactcaagagcggcgcgcatcaccttgggcccaaggctgtgttcgtggctcgtttgcctcgtgagaggcggtgaatcatcggcgaagcgactttggaagcaatttggccattggtgcctttgggctcttccggtctcctcccctatggcttgttgctactgctgttggaaagttttaactttgcgcagaagggttgccggctgctggctgtatgggagtttgtgtttggcgatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctggg

SEQ ID NO: 4696 - DNA, 4852 bp, Homo sapiens
  ENST00000273857
atgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatca

SEQ ID NO: 4697 - DNA, 3200 bp, Homo sapiens
  ENST00000508498
ttttacttggctgtctcaccacagccagccccatgaagaggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagact

SEQ ID NO: 4698 - DNA, 3112 bp, Homo sapiens
  ENST00000502252
agttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtctgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgt

SEQ ID NO: 4699 - DNA, 3018 bp, Homo sapiens
  ENST00000505909
atgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaa

SEQ ID NO: 4700 - DNA, 582 bp, Homo sapiens
  ENST00000515827
aacagggagaatatgacaagattcaagaagagatttttgaaatcagatacaaaatgtttagtataaatgtttcaagtttggaacaggatatttagaattgcaaaaaatttatcttatccactgtgaaaggcatttatatgtcaagatgaactgtcaaggactgaggctggatgcttagattattttcccccatcaatagatggaagaggacaaaccttatccttcaactgaagtgtgttacatgtctaggtaattcctgcacttctgtcttgttgttagaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgccc

SEQ ID NO: 4701 - DNA, 680 bp, Homo sapiens
  ENST00000505754
ctagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaaggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtggtgagctacttgtttctgccatctgttgtactctctcatgcctgtcagccactgaagctgaatggatcctaaattacttcctggattttactgaccaagttcatctattttgttttactgttataaaagctgatagtgctgatctatgtgtgttatttccaactcacagaaaatttccccacgaagctacttctctatttgaaatatctatattgtatggaaaaacgtttgggttcaaaatgttgtaatcatataattgctgggagaggatttaaaaactcttcattaaaacccaacttcaataa

SEQ ID NO: 4702 - DNA, 2417 bp, Homo sapiens
  ENST00000504584
agagcagacaaaatatggggcccctggcgcttaaagttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtggtgagctacttgtttctgccatctgttgtactctctcatgcctgtcagccactgaagctgaatggatcctaaattacttcctggattttactgaccaagttcatctattttgttttactgttataaaagctgatagtgctgatctatgtgtgttatttccaactcacagaaaatttccccacgaagctacttctctatttgaaatatctatattgtatggaaaaacgtttgggttcaaaatgttgtaatcatataattgctgggagaggatttaaaaactcttcattaaaacccaacttcaat

SEQ ID NO: 4703 - DNA, 1965 bp, Homo sapiens
  ENST00000503821
agtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaaggttaattttaaaattaattacagcagggtatctaacatggatgaacatgttagctaccttttgaatttcttctatttatggcttcttgtttgtttgttttctatttagtttccaatcaggctgcttaggtgagtgaatttgtgaacttgattgcattgaagaatttggcactcatctgttagatattgcattcattttaaaaataaagaagtcattttctatt

SEQ ID NO: 4704 - DNA, 5378 bp, Homo sapiens
  ENST00000502726
agagcagacaaaatatggggcccctggcgcttaaagttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtggtaagtagcattgtttccccaaaggttttaatttaaaatcatagaaatttataaccaaaaacttacagttcattatgtgttaatatgattagcagtttaaattacaaaatgattggtttcttgttttttagaaggaggaagtttgttcagtcactgtcctcagtaatgtcttatgtgtaaatgtaatacctaaaaaatcatattaagaaaatgtttaagaagtgggatgggaagactggtaaaggttgttaatgcattaatagttttttttcctctcctcaaatgtgttctgtttctcctctggttagagccagtggcttacgttagatttgggcttttgagcaaactttgagggcagatatattgtctgtgcctgattcccttggtacatgtgactgaagtcccctcctttatttaatcctcaaatagtacagggaccacctgttcagcagctacacccagggttaggatgatgcatttgttttgtgtacacatggtgatcttatcttttaaagaataaccccactttttaaagagtcatgtccaattctgaatgccatctcatgaattaaaatcagcaaaattcctcttgctcatttacttttttggctttgtgactagcttcagaatttttaggtagcatattattgagtgacgtaggaactttgcaacatgaacaaaagggcaaactgggatgaggatacaccctggacaaatgatatcagacaatgtcctgcattagataacatcaaaatgaatgtttgggaaggatcagcggtatggtcagaggaaggcattggaatcatgaatgttaggaataaccccatgctgggaaacctggtggtttctaggagcgctgtctagctgccacttgctgtatctgtaaaaatattttaaaatgtatgtgtacaaaccattcctgtgtgactagatagaggtgggttattgcttttttctgataatagtttatttttattttattttgactaataatagttgtacatatttattgaatacagcatgatattttaatacatgtatacaatatgtaatgatcaaatcagggtaattagtgtatccatcacctcaaacatttatcatttctttgtattaggaacattcagaatcttctcatttagttatttgaaaatatgcaataaattatcattaactatagtcaccatccagtgctataaaaacctacaacttgttcctcctatctagctgtaattttgtatcagttaaacaatctctgtctctctctctcttttttttttttttttttttttgagatggagtcttgctccatcacccaggctggagtgcagtggcgctatcccggctcactgcaatctccgcctcccgggctcaagtgattctcctgcctcagcctcctgagtacttgggactacaggtgtgtgccaccacgctcagctaatttttgtatttttagtagagatggggtttcttcatgttggtcaggctggtctctaactcctgagctcatgatttgcctgcctcggcctcccaaagtgctgggattacaggcatgagccaccgcacctggcagcaatctctctttgtccctcctcctccatacccttctggcctctagtaaccactgttctactctctatttccatgagatcaactctgcatatgagtgagggcatgtggtatttctgtttctatgcctggcttatttcactaaacagaatgtcctccaggctcatccatgttgctacaaataacaggattttattcttttggcgtggctgaatagtattccattgtgtagatgtaccatattttcttctccactcattttttgatggcataaattgattccatatcatggttattgtgagtagtgctgcagtgaatgtgggggtgcagatgtctgtttgatatactgatttcctttcctttgggtatatgcccagtagtgggattgctgggttatatggaagttctatttgtagttttctcaagaacctccatattgttttccataatgactatactaatttacatttagatgtgggttatatcctgggactgactagtcttgagaaaaaggatgagaggaaattgtaattatatagatcacagaaattatagttgcaggaggccttggagatcatcagattcaacccttccctttaccagtgagataattaggaaatgcaggggattgaaaatgagtgagtgtcgtttggtagttggataggttagtggagagggccagcatgcaggtagcatgtgagaaaaaatggtcttaacaggcaacagaattcctctgaagatagcaggctatcatgaagtttgtgtgtctggatgccagttgtctccatctaatagcaataattatcactttccttcagaccagcctctgccctggctccctgtgctcttctggttcctgcccaagcacttcttatgcttttcttcttttctcaaacctatgtcctccctatactttcctctgttgatccaaaatatgctttaagatccatggtcactccggaagtctgtctatgaccatggcactgttactagactcatcatactttctcatggaatctattattcatgaatccacatacatcttctaaaacactgcttatattcagggtataccacctctcatggcaaagcatcctatggattctgccctttgtgagagcgaacttatcacttagttctttttcactaatatataaattgggacaaagttgaagtccaggctaaaaagaatcatgaatataacataaatattttgcatggcttacctagcagttcttttggatataaggccaggcatgctggcatattccttgtagtcccaactacttggaggctggggtgggaggatcacctgatcctaggaggttgaggctgcagtgagctatgatcacaccactgcactccagcctgggagaaagagagagaccttgtctcaaaaaaaagataatcaattaaaaacttaagcttagcatcaggagagatgacaaggagatacgtgccttcccaatttgccagacaggtaagttataattcctagaaacgtgagagagctgttacagatacatcaaatccgctagccgcattgtgaaacacaaatcacagttctgttttttgaaccagggtagaaatcataaatttttcataaggaaagaaaatgacaactaaagaaaacaaaagccaacaacaataagaacaaactacgggtcctggggcagctagagtagttacttatctgaaaaacagacccatcttaccccacagtgatggtggtcagtggggcacatgagtggggagggcgtggcattttaattgggccagacctattgtagaaatgttattgaaggtattggagccattggaacagactctcttcgatgggaactgggagccatagaatcctgcctgttagtcatgctggttctctgcatcctcgtgagttttcatttctccagattgcaatcccacaacagagcatcgctgcggggacgggcgctgcatcgccatggagtgggtgtgtgatggtgaccacgactgtgtggataagtctgacgaggtcaactgctgtgagtgctctgaggacgtttgttttgcttatttttccatttctggttctttaggctgtactcaaggttgaggactgtacttaagactcactatatacacagcattccaagggaaagattcttatgctttggttctagcctgtaaagatcactgagtcatgggatgacaatagcaatggagtgtatctgacttccacacctctccctgcaaaactccaagcttcatttggctgatctagccaagtgggtgtctgttttctctctcgttgctccatatgtctcttttatgcttctgtgactttgtcaaaggtgatgctctgcccacagaatggggaacctttcttctgcaaacaatacatgagtagttaagcttccctgcaggagtgccctaacatgttttcaggggccatttgtggaagaacatggaaagaatcgtcagagagaagagagcctttaatgttcatatgatgatacaaagagagcataataggccgggcatggtggctcacgcctgtagtcccagcactttgggaggcagagatgggtagatgacctgaggtcaggagtttgagaccagcctggccaacagtctctagtaaaaatacaaaaa

SEQ ID NO: 4705 - DNA, 482 bp, Homo sapiens
  ENST00000510974
acactggcggcaggggaggctgcaggtggagctgtcggagccagcccctcggggatctacagcttcctgtctgcgccggcgtctcgggcgccgggtggctggagggactgtgcagcagtcttgcctgccccagacgtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaag

SEQ ID NO: 4706 - DNA, 4696 bp, Homo sapiens
  ENST00000610355
agagcagacaaaatatggggcccctggcgcttaaagttcagtttgtctctcttgagcttggagaaaatcatccgtagtgcctccccgggggacacgtagaggagagaaaagcgaccaagataaaagtggacagaagaataagcgagactttttatccatgaaacagtctcctgccctcgctccggaagagcgctgccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcatatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatc

SEQ ID NO: 4707 - DNA, 3892 bp, Homo sapiens
  ENST00000261401
gcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 4708 - DNA, 2487 bp, Homo sapiens
  ENST00000541050
gcgagaccagctctgggccctgcagatctcggttgggggtcaggcggggcggggcagagctggagctggagtaatgtgggtgggggcggcttgggaagaggctgagcccggccaagggagcagagggctgggactggctgggggttgggaggggaggaacgaagcaggaaggctgtcggatcgggggcccagggtgtccgagtgaactgggtgattcagagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaact

SEQ ID NO: 4709 - DNA, 577 bp, Homo sapiens
  ENST00000546705
agcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaagaaattgggtgtttgtaccagaatggaattttgcttctcggttatcctgtgcttcagatgattataatctaacccaaa

SEQ ID NO: 4710 - DNA, 891 bp, Homo sapiens
  ENST00000549384
agtgccaggctggaggcggcagcggttggaggcttcgcccggctttgcagcggggacttcggcggcggcgcctcaggcacctcggcccggacacgatgaggcgagtggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatg

SEQ ID NO: 4711 - DNA, 1296 bp, Homo sapiens
  ENST00000421578
acacttcatatcacaacaagcctgtaaatcctgccttaaacaaactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacag

SEQ ID NO: 4712 - DNA, 1245 bp, Homo sapiens
  ENST00000550542
cggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcagaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccct

SEQ ID NO: 4713 - DNA, 1710 bp, Homo sapiens
  ENST00000549772
ttttgcttttcaccacctcatggaagctgtcttatctaactcacgcttgagaagtattcatattgattccaaaatgaaggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaaggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctga

SEQ ID NO: 4714 - DNA, 873 bp, Homo sapiens
  ENST00000549387
aggatacaaataaaaatgttatacctttcttccccattacagagctctttgctcccttcttccagtattacagtgcaagtggctttacattctctttccacattttggatagtttcacatttttcttgagtgtcatgtacgatgtggtttgctaggatgagaaaatcataatcctaggattgttttcttttgctttctaaaagtcatatttatacttatatgttcaaccacctcaagctggcagaagaccttgtacccgcgttgtagatacaatctaacagatgtgtgttctctcctgtaggttgacatggtaattttttcataagtgagtcagtttcagtgttgctattatttccaccacagttggtctgtcccccagataattggcatttgtcatcatcatacgtagacctctactcatggttcttgtctccagtctgccagttcctagcatagtgactctcagcttccgttctctcatctgtcaaccgggaacactaaattctgcctattcccggggtggatcagatgtggggatgggtaaagaagcacttgacatttcagacagcattgtagaaaactaattattcatcctgttagtcagcctcatatttcacttaatgcaactttgcctttatttcccctctgaagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaa

SEQ ID NO: 4715 - DNA, 547 bp, Homo sapiens
  ENST00000552030
atgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagacaagattgccgtcattgttcagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaag

SEQ ID NO: 4716 - DNA, 683 bp, Homo sapiens
  ENST00000547361
gaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccaggtaaagaatcgagattgtcaagtattctaggttggtgtaactgtgtgacaattatttgtacttggactagcatatacttcagatctcaaaaatatctgaccattctgagcaagaaagtagtagaattgtacacattgccatgagatggcactttctaaggatatcactaaaactgagtttcttcattagaaaaaaatctcaaaaaaaaaaaaaaaagaaaagaaaaa

SEQ ID NO: 4717 - DNA, 587 bp, Homo sapiens
  ENST00000552871
agtgccaggctggaggcggcagcggttggaggcttcgcccggctttgcagcggggacttcggcggcggcgcctcaggcacctcggcccggactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaa

SEQ ID NO: 4718 - DNA, 566 bp, Homo sapiens
  ENST00000547294
actaggcggtttggtaacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctg

SEQ ID NO: 4719 - DNA, 547 bp, Homo sapiens
  ENST00000550032
aattctaacataattctcactcttcctttgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttgga

SEQ ID NO: 4720 - DNA, 547 bp, Homo sapiens
  ENST00000551550
aggctttcgaggtccggaacgctcctggccgggtgcggagccgcgggccgagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacagggg

SEQ ID NO: 4721 - DNA, 899 bp, Homo sapiens
  ENST00000546571
gctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatgacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacag

SEQ ID NO: 4722 - DNA, 567 bp, Homo sapiens
  ENST00000551044
gtcggatcgggggcccagggtgtccgagtgaactgggtgattcagaggtgtgtttccctaatagcggggcagctggcgagggacgcagtaaaaaggagcgaggtgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggtggga

SEQ ID NO: 4723 - DNA, 804 bp, Homo sapiens
  ENST00000547170
agaaggcttttgaagtcaagggtgatggctgtgtcttttgaattcctcccatagctattcttgttgaaacactctggggaatagacacaattctcagacagcagagtgttgatgtctagggaaaatgtttacaatctgaaaaattaccttggcaggctgaggacaaagccacaaaatcgtaacttgtttttcggctttcttcagcctcacctctaccagagaatttcactttggagttttcttatctgtaaaaggggaagggttgaagtacattatctgtcagctcccacccaaccctgaaaggctaattttctttaattctttcccttaatctttccattgaaattaaaactgatgagctgtttctggatcttgaattaggaatttttcatttctttgtaattctttccctgacgcattttgcagttgtctccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaa

SEQ ID NO: 4724 - DNA, 474 bp, Homo sapiens
  ENST00000551059
agtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaaggtaggtaatttgatcttccattctggtagacaccctctgatagtctccatactttttccttaatagattgacagttcactaagaattgtatttgtgaaaccattagactctgatgtaattgaagttaagttccacacgccttactaaccacatcagtttttctctaacagagaatcattaaata

SEQ ID NO: 4725 - DNA, 3921 bp, Homo sapiens
  ENST00000420959
aggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaaggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgatt

SEQ ID NO: 4726 - DNA, 5635 bp, Homo sapiens
  ENST00000343933
cactgacatctttgctggactcttttaatcctcataaacccaggctgctggcacttgaaatttgagaagggcaatcagtctggcctcctgcctttctggcctgcaggcccagcctggacaaacaatttaggtggagctcctggaggctggaagcagagaggaggtacctcaccatcctctcctgccagctgttgcagactctgcctggggaactgattaagggtgagcagaggcatttatctccatgttaacaagcagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccagctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactacaa

SEQ ID NO: 4727 - DNA, 5459 bp, Homo sapiens
  ENST00000375077
cgggagtcggcgggcggcgaggagcgcggagccggagctggacgccgccgccgccaccgccacctgcgcggcagtcatcaagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccagctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactacaa

SEQ ID NO: 4728 - DNA, 3569 bp, Homo sapiens
  ENST00000261861
cgggccctctccctctctccctttcttcctgcctcgccttcctgcggcgaaggaggctcatctattataaatgcacattcggggctgacatcagcgacgagcggcgggcgagcgccgacgagcggtccctgcgcgctgcccgcccggagcgcagcccccaggctcggccgagccgccggcggggcgcggggagcgagccgggagctgccggacccccttccgccgccgccccgggccgccgccgccgcccccgcacgccgcgcccgcgcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaa

SEQ ID NO: 4729 - DNA, 3566 bp, Homo sapiens
  ENST00000566799
cgggccctctccctctctccctttcttcctgcctcgccttcctgcggcgaaggaggctcatctattataaatgcacattcggggctgacatcagcgacgagcggcgggcgagcgccgacgagcggtccctgcgcgctgcccgcccggagcgcagcccccaggctcggccgagccgccggcggggcgcggggagcgagccgggagctgccggacccccttccgccgccgccccgggccgccgccgccgcccccgcacgccgcgcccgcgcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 4730 - DNA, 3332 bp, Homo sapiens
  ENST00000540068
attcaaaccgcctgctgggtgccgtgggccattgtgcaagtcttccaggccgcggtcgaatgattctgacaagcgatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 4731 - DNA, 3611 bp, Homo sapiens
  ENST00000543950
acagattctgttgacctttagtaatgagggaggcagggctagagggtgactagcagccaggcctcccaggctcccaggcctctcagatgcctggaatttcggagctagaaggtagtcagattcccgttatcttgactgctgcagcggggtctctgggatggtgatgtgagtgcctcctgcacccgtggcccccatgtggcataactccttgggcgctattcatccacacggcccatctgtgcagggtacagccttcatggtcttagctggcagccctgacaacttggatgtgcaaagaagatacaagtttgtttcctctgaagcttgtctggtgtcatccaggagccccacctgatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 4732 - DNA, 2378 bp, Homo sapiens
  ENST00000469090
cgcagacgggaagctgctcagcaccggcttcagcaggatgagtgagcggcaactcgcgctctgggacccggtaggccaggccgcgccgggcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttgggttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 4733 - DNA, 2603 bp, Homo sapiens
  ENST00000345068
gatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcc

SEQ ID NO: 4734 - DNA, 4069 bp, Homo sapiens
  ENST00000459686
gatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggtctctgccctaagtaagcccccagcctgcaattctctgcccggctcctgttccctcccctcccttgcatctcagaagctcagagaagggctcctcgctttgggattgaggaggggagaagctggaaactccatcctcccaccagaacctgcatgaaacctgagctcctggacccctctcctctcagccggcacccagacgcatcttccagggtctggggcctgacactggctcgagggctggccctttctccttgtggacccgctgggcgggggatggggcaaccctcgcgcgttgcttatcccagccggatgccctgggagggcggcggccctggcctcgccagcctcaagtctaacctggggtgcgggtgcgtgggccgcgtgcatgtctgcgtggagcaagcgcgccgagagcggtcggggctggcgccggggcgctctaacccactaacccggcgagcaggagcaagcccggcctcacgagggcgcccgcccgctgcgggctgtcttcaccgcagacgggaagctgctcagcaccggcttcagcaggatgagtgagcggcaactcgcgctctgggacccggtaggccaggccgcgccgggcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttggggtgtgtgcctcggggactggcatcacgggagagtggccaggcgccccccacccgcagggcatgcccacctggacaggactgaaggctgctgccacctctgcagcgcctgccattctcacacccacccctctgcccagttttgctgcgtcgcgtgaaggatcctgcgctggcgcccccacctggtgatgccgagtccctgggggtggtttgctgtgactgcatgcggcgcgcagcgggtatatgtgcaggggaggaggagctatgtgcgcaggggaggaggagagatgtgcccaggggaggggcctgcaactctggtcactagaggtttggggcatagggtttgggaaggccaggaagcgtaaaggggcttctgggggtcccgaagtagcacgggagggtggggcagggctggtcacgcctcctgtgctcgggcagaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagc

SEQ ID NO: 4735 - DNA, 2345 bp, Homo sapiens
  ENST00000580212
ctcctccctcccgcagctcacaggactaaggaccaaaggcatttctgggcactgagatcctacctctctgcctgcagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaa

SEQ ID NO: 4736 - DNA, 1847 bp, Homo sapiens
  ENST00000579388
ctcggggactggcatcacgggagagtggccaggcgccccccacccgcagggcatgcccacctggacaggactgaaggctgctgccacctctgcagcgcctgccattctcacacccacccctctgcccagttttgctgcgtcgcgtgaaggatcctgcgctggcgcccccacctggtgatgccgagtccctgggggtggtttgctgtgactgcatgcggcgcgcagcgggtatatgtgcaggggaggaggagctatgtgcgcaggggaggaggagagatgtgcccaggggaggggcctgcaactctggtcactagaggtttggggcatagggtttgggaaggccaggaagcgtaaaggggcttctgggggtcccgaagtagcacgggagggtggggcagggctggtcacgcctcctgtgctcgggcagaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttc

SEQ ID NO: 4737 - DNA, 3502 bp, Homo sapiens
  ENST00000467534
gccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggtgagtgcctggcctggccactccccagaaccccttgaccagtggccagctgtcagcacccttgtacccaccattatcagagcccctggtcccggctttcacctgtcgcatccctgctccagagactagcccccttcccccgtctctgcaaccacaggtctctgccctaagtaagcccccagcctgcaattctctgcccggctcctgttccctcccctcccttgcatctcagaagctcagagaagggctcctcgctttgggattgaggaggggagaagctggaaactccatcctcccaccagaacctgcatgaaacctgagctcctggacccctctcctctcagccggcacccagacgcatcttccagggtctggggcctgacactggctcgagggctggccctttctccttgtggacccgctgggcgggggatggggcaaccctcgcgcgttgcttatcccagccggatgccctgggagggcggcggccctggcctcgccagcctcaagtctaacctggggtgcgggtgcgtgggccgcgtgcatgtctgcgtggagcaagcgcgccgagagcggtcggggctggcgccggggcgctctaacccactaacccggcgagcaggagcaagcccggcctcacgagggcgcccgcccgctgcgggctgtcttcaccgcagacgggaagctgctcagcaccggcttcagcaggatgagtgagcggcaactcgcgctctgggacccggtaggccaggccgcgccgggcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttggggtgtgtgcctcggggactggcatcacgggagagtggccaggcgccccccacccgcagggcatgcccacctggacaggactgaaggctgctgccacctctgcagcgcctgccattctcacacccacccctctgcccagttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttc

SEQ ID NO: 4738 - DNA, 1581 bp, Homo sapiens
  ENST00000480954
cgcagacgggaagctgctcagcaccggcttcagcaggatgagtgagcggcaactcgcgctctgggacccgttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaag

SEQ ID NO: 4739 - DNA, 1416 bp, Homo sapiens
  ENST00000584969
atgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagcaagcccggcctcacgagggcgcccgcccgctgcgggctgtcttcaccgcagacgggaagctgctcagcaccggcttcagcaggatgagtgagcggcaactcgcgctctgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactag

SEQ ID NO: 4740 - DNA, 492 bp, Homo sapiens
  ENST00000577909
cttaggttgatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacga

SEQ ID NO: 4741 - DNA, 868 bp, Homo sapiens
  ENST00000492276
ggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctcacaggactaaggaccaaaggcatttctgggcactgagatcctacctctctgcctgcagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagacctt

SEQ ID NO: 4742 - DNA, 559 bp, Homo sapiens
  ENST00000584602
aggttgatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagt

SEQ ID NO: 4743 - DNA, 2397 bp, Homo sapiens
  ENST00000388767
ctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 4744 - DNA, 1843 bp, Homo sapiens
  ENST00000262428
gtggaagccgccgccgcgctcgcagcttgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaca

SEQ ID NO: 4745 - DNA, 5330 bp, Homo sapiens
  ENST00000567278
gtgggtttcatagctgtgtgttttcatttggctcctcttccttggggattgccttgtctcctagcaagattcagggtgctggggactgtggctgtatttcttcagcagttcagagtctttggtttattggtcatcatcacccacttgtggaaaagacacattcatgtgtccagcacatgtcttgtctatccccggctccatcttatgcctgcgggaggggagattctagtccccacaccgtgttgtgagggtttgggaaggacctgaagccagcaggcagccttcattgtgagagctatgctctgatcccaaagctgacttttccatgccaggtttccccattgccctaggatctggtgtccctggtggaacttcgtcccgtgtctatgtgctctggaggcttaggtgtaggatccctggatgactggtggggaaaggctgggggaccctgttgtccagccttcttctttcacagaggtggaaaccagggcccagagccattaaatactgccttccgggcatttcagagcccgctgcttctatttttctattctcagtctgtcagagagaccagtaagtaccagaattttgacttcccagagcctaggagagtgtatggcatatgacaggtgtttattaatgtgtgttcgtgggaagaacaaattgtgtcgctttcattgtctttcaatacaatgaagatcagttcctctcctgggccccacttcatagaaatatgcattcctgacttcacaaatggaactgcccaagaatccccactcatgttttctccccggagcttcccctgcacccacattctctgcattggttaggaatatcctcataggcgcaacactcctgaatagcagaccttacacttgtaccccgacaggcctccttgttccctgaagctaaccctgggcctggctttggggtttgcagccggatttgtcatcttctgtctgccagtttcactgacttggttattccaaggaattcctgggacttccctttgttaaaaaataaacgttaggaatgagaagaggaactagctactgcctgtgtcttcactctgagtgactgagggaacttcattaaatctcagattcccctaacgatcctgagaatgaaggtgaacccacagtcctgtagaacattctctctgactgttgagcactccgctttgtaccaggtgttctcatcaagtgtgcaagccccttttatgctcatacgaccctcccaacagccctaggatgtgaagctgctattgtccgcatttgcagatgaggagactcaggctcagggaggttgagtccccagggaggctcaggccactggagatgcctgtggacaagggtgcctgtttgtatttggcctggacctgctcccagcatgctggggtttaaacctgggcagttgggagccattaaaaaatgaaaaggggtcaggtgtggtggctcatgcctgtgatcccagcactttgggaggccaagggggggagatcacttgaggccaggagttcgagaccagtctggccaacatgatgaaaccctgtctctaataaaaatacaaaaatgagccggccgtggtggtacgtgcctgtaatcccagctacttcagaggctgaggcaggagaattgcttgaacctggaagtggaggttgtgctgagctgagattgcaccactgcactccagtctgggcgacagagtgagactccgtctcaaaaaatgaaaataaataaaaataaaaatgaaaaggatgggctgggcgtggtgactcacccctgtaatcccagcactttgggaggctggtctcgaactcctgacctcaggtgatctgcctgcctcggcctccaaagtgctgggatgacgggcgtgagccaccgcacctggcctgaaccattttaaagtgtacaattcagtggctttcagaacattcacagtgttgtgcaagccctacctctgtctggttccaaaactttttcatcaccccaaaaggagatggtggctctttcaagacgccagctttggcatcaactggaccttctggttgtctgacttcggacaagcattgtaatttccagcctttgtttcctcacctttaaaatggaaataatgttgatcaccttacgggcctttttaaaaagaacttgattgaggtatgatgtatgtacctcaaaatcaagtcatcctaagtgtactttttcagtactttttcgtgaatttgtggagttgtgcacccattaccacaatcccaattttagaacgtctctatcatttcctgttcccatctccagctctgtgtaaccacgagtctgctttctgtctgtatgggtttgccttttttagacatttataccaatggcagctgacagtacatggtcttcatgcctggcttctttcactcagcatcctgtttccgaggttcatccatgtagttgcgtgtggcagcgcttcattcctctctgtggctgaggaatattccattgtgtggacggaccgtgttttgataatccactcctctgttgatggacataggggttgcttccaccttccatgattcatatttactactgtgtgtcattctcagtactgtggcactgtgctggtacacataagtgcttaataattgtggttagccgggcgtggtggctcacgcctgtagtgccaacaccttgggaggccaagctgggcggatcacttaaggccaggagtttgagaccagcctggccaatgtggcgaaaccctgcttctactaaaaatacaaaaaatagctgggtgtggtggcagacgcctgtagttcgagctacttgggaggctgagacatgagaatggcttgaaccctgggggcagaggttgctgtgagccaagattgcgccactgcactccagcctgggcaacaggcttttctctcaagaaaaagaaaaatggtggtcattgtttatgttatttccttatgggcttttttttttaatgtggatgattttcttacctttagacgtgttatttgtggttttgatagcttttttttgtcaagctgtccgtcatcgttctgaaattttgtttgttaaagtcttatgatccacatatggcagtaactgtgtatcatcatggcttaagggtgtctgataagccaggtcacctggttccctcattcatgccacaagcgtttactgagtgcatcatgggtgcctgcgggttctatgggtgaaacctgtgtactgcaagaggaaagactgactgcatccattttgctgagccctgtagccccacagcctggcgtggtatttgttgaaagaaggcagagcctctaccctcgtgtaactcagtgcgggtggagagcccatggcagacccaggactggaggctcctgcgtcattaggaacattggtggctgaagcttgcttgtcccagctggcgagagccaattacgcctgtctccttccacctccacgtatggtgacatcactttgatagcttgacgtcagccactgggggactatttacatcatggatatgggcaaaagacaccaatctgagcttttgtccttttcttttttttggagtgcctgcacacccgtgagcctttccaacctcgtaacctattattttcctgacgagatagttttttacagatgagaaagttgaggcacagagaattgaagggacttggccaaggtaacagcccaaattcaagccccagcttcctcgggccatccccacggacatgggaagacgcagcatcagatctgccccactccctcctcccagtcaggttttttctgccagatgactctgctgttcaatttccattgactctgctgctgaatttccattgactgactctgctgctgaatttccatttccatctctcatcagggttttcagtgctttgcttcccagtgtgttgcctgagccaccctcacatcctgtgccttccttcttaataggaacgctgtgttttcctttgttcttgcagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttc

SEQ ID NO: 4746 - DNA, 1677 bp, Homo sapiens
  ENST00000564057
ctcgcagcttgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattg

SEQ ID NO: 4747 - DNA, 781 bp, Homo sapiens
  ENST00000561707
gaagcctgcagcactgttgccaggattcaggggagtgtgacaagggcagcggatgagtgcttccctcctgtcctctgcacatggtgctcccagggaactgcaccggtctcctgctgtgctgctccaggcgcactcgtggctcacagcctctccccagggacatgacatgggggtgttttaacgcagcaccatgttctcttttcgcttttggccacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcaga

SEQ ID NO: 4748 - DNA, 713 bp, Homo sapiens
  ENST00000564662
ggaagccgccgccgcgctcgcagcttgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctggtaggaacttttcattcgtctccacgccccgctccccgggctcgcgcggggcctcgtgcaccgagccggcctccaggcgggacggattcgggcctcccgcgctgtcttcctcgccttattccgggacggcgtgccaggcccccgcgggcttctccgtggccagcgcgtctgttagattgtcctctgcaagcgccgcgtcgcgcggccaccagcgctgatgtgtgtgtgtgtttttttcttctcccaacccaaagggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccc

SEQ ID NO: 4749 - DNA, 531 bp, Homo sapiens
  ENST00000567786
caccatcgtccccggcgagcagggagcggagtaccagcacttcatccagcagtgcacaggctggagtgcagtggtacaatctcagctaactgcaacctccgtctcccgggttcaagagattctcctgcctcagcctcctgagtagctgggattacaggcgcccacgaccacgcctggctaattttttgtaattttagtagagatggggttttcaccattttggccaggctggtctctaacttctgaccttaggtgatctgcccaccttggcctctcaaagtgctgggattacaggcgtgagccactgcgcccggccgacggtgtgggttcgaatccctgaacggctgcttcctggctgtgtggtttggaacgagttccttaatctctgggggtcttggtttcctcacctgcactctcacagtgctgttgcgaggataagtgagtcagtatgtataaaatgctcagaacagtgcctgtacaagctacatgattgtttgcgaaataaataaaaagtacaaaattgtgccaggg

SEQ ID NO: 4750 - DNA, 1944 bp, Homo sapiens
  ENST00000588572
cccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgcagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacatttaaaagatttcagaaggttcctggaaattccaatgtccacccatgagtcctcagctgagactccctgctccgctgccctctttgtctaagagctgtggcaacagcacctgaatttcagaaacaaaaggccgggcgcggtggctcacacctgtcatcctagcactttgggaggcagaggcaggaggatcgcttgagctcaggagttcgagactagccttagcaacacagtgagacacaattgctacaaaaagattttaaaattagtttgacggggtggcgtgtgcctatggtcccagctactcaggaggctgaggcaggagaattgcttcaatccaggaggtggaggttgcagtgagccgagatggcgccactgcactccagcctgggccacagaccctgtctc

SEQ ID NO: 4751 - DNA, 1663 bp, Homo sapiens
  ENST00000326529
gcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacatttaaaaga

SEQ ID NO: 4752 - DNA, 2083 bp, Homo sapiens
  ENST00000593184
agaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatggtagatgcctcgcgttgacagctacgagccagcccagggtccccagttctcaacactgtcccacccagatggctccaaggccaaggagtgccgcttgacaaagccctagggttccagcctggtcctgctgagggagccgtgagaccagtcagcctggggtgctggttttcccaacgggtactccctgagctatcagccttccagaggggctcctaggagggggaagccccatcctctgactgaagcggtcctatgaggccctgttcaaccccagggttcaaaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtccccagagccttgacgaatgcacagaggcgctggcagaaccacgggggcaggacccctctctgagtcacagaatggagctaagttggtgaggtcacccagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacattt

SEQ ID NO: 4753 - DNA, 1396 bp, Homo sapiens
  ENST00000590900
ggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgcaggtagatgcctcgcgttgacagctacgagccagcccagggtccccagttctcaacactgtcccacccagatggctccaagggtgaccctagacaagcttcttgacctgtgtgagcccgaggttccccaaggcaaaccaagatggctcagggccccattatcagaggaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtccccagagccttgacgaatgcacagaggcgctggcagaaccacgggggcaggacccctctctgagtcacagaatggagctaagttggtgaggtcacccagccgccactgccccactgatgcctgagccaggggcaggggcagacctgcccggcctggcctccagcctggtggaccatcacctgtgcaaactccgaacacctcctccaggtgctctggctggctttccctggtgtccagtagccgcctcctgagacccctaatgccagcctcacagtctcagcaacctcccagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggt

SEQ ID NO: 4754 - DNA, 690 bp, Homo sapiens
  ENST00000589879
gcaggtagatgcctcgcgttgacagctacgagccagcccagggtccccagttctcaacactgtcccacccagatggctccaaggtgctcctgcctccaatcaccacacctacctctcacctcagtcctttccctactcccctcctgcctggaccatctccccaggctccttccccatcccacccctgatccatcccatctcgggtcctgaggggtcttctttgtaccacccagcgctgactccatcccttcctcccccactctctgggctctccaccactctccatcacgaccccgctcccacctggctcatttcccctcccagaacatcgagatccccatcatgtgagccagcttatttccaacagaatcccctggtgtccacgctttcggcacccgcacccacagccagcctcctgacctccccagagccgtgtctagaacccatttttgccctgttggccagccttcctccttcctcctcctcccatcatcctatcttcactgcctccagacctcatctcagcacattctcacactcccgaccccctctgcagccgccactgccccactgatgcctgagccaggggcaggggcagacctgcccggcctggcctccagcctggtggaccatcacctgtgcaaactccgaacacctcctccaggtgctctggctggctttccctggtgt

SEQ ID NO: 4755 - DNA, 162 bp, Homo sapiens
  ENST00000588586
gacgaatgcacagaggcgctggcagaaccacgggggcaggacccctctctgagtcacagaatggagctaagttggtgaggtcacccaggtaacatcccaagcacagggtgccacacctgtgcagccacagcagcctcctgacctccccagagccgtgtctag

SEQ ID NO: 4756 - DNA, 319 bp, Homo sapiens
  ENST00000586191
gtgatcctgcatctttttgtctcgcggagccccgggtctcggttatccacccctacctcccagtgtctaagccacgaataatgggtgaccctagacaagcttcttgacctgtgtgagcccgaggttccccaaggcaaaccaagatggctcagggccccattatcagaggaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtcc

SEQ ID NO: 4757 - DNA, 479 bp, Homo sapiens
  ENST00000589467
gcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatggtatgctgtt

SEQ ID NO: 4758 - DNA, 494 bp, Homo sapiens
  ENST00000587357
agaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctgggtgagacctgctcagccaggttatgggaggagcagggtgtgacaagggacggcagggaggggcactcccaccctaagtcccgcggagaccgttagggtgggaggccgggcggggccgggttggtgggggcggggcctggtcgagaaaaggcggggctgagcctggaggggcggggcgaggttggtaggggcgaggcctgatctggaaggtgcggggccgagtcgtgaaggtgcggggcgaggtaggtaggggcagggtctgggtaggaggagcagtgtgagggaggtaggggtcggggcctg

SEQ ID NO: 4759 - DNA, 548 bp, Homo sapiens
  ENST00000587854
atcccacagcagatccagtggccgccaacgtcaggctggtgagggcacgacgggtggggttcaggggcgggggtcaggatggggagacgggtcggagcgagggcgccccctcggccccacggagtccccgtcccgtcccgtctcgcaggagttgcctccttcgtggatgttggatgtggaagcccaggagccccccaaggggaaatggtcgacgccgcccttcgacccgcgcttccccagccagaaccagatccgtaactgctaccagaacttcctgggtgagacctgctcagccaggttatgggaggagcagggtgtgacaagggacggcagggaggggcactcccaccctaagtcccgcggagaccgttagggtgggaggccgggcggggccgggttggtgggggcggggcctggtcgagaaaaggcggggctgagcctggaggggcggggcgaggttggtaggggcgaggcctgatctggaaggtgcggggccgagtcgtgaaggtgcggggcgaggtaggtaggggcagggtctgggtaggagg

SEQ ID NO: 4760 - DNA, 564 bp, Homo sapiens
  ENST00000513982
atatgataaatagtacctggagcgcctacttcacaagaaagcctgagagagtccagttgtactcaaggagagggagaagtagccaggagacagatccggtaggactgtgaaagccatggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagac

SEQ ID NO: 4761 - DNA, 2421 bp, Homo sapiens
  ENST00000402744
gcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatcccc

SEQ ID NO: 4762 - DNA, 437 bp, Homo sapiens
  ENST00000480404
tcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctgattgcaagctgtatgaagtggggaccctgattccagcacccagctcatgtttggcacacagcgggcttgaatatacattatgaaataatctacattatggaaaaatactgaatatgcagtgtggaaaaaatgaatccatcaatagctgcataacacagtgtattaaaataaaatgttttattcttcatacattc

SEQ ID NO: 4763 - DNA, 633 bp, Homo sapiens
  ENST00000431967
ataaatagatataattaatgaaaatgttaatagtgccggtctccagaatatctctagatcactgaccttctgattggtggaaaaacctttggagaatgatctttacaggattccatggcagtgagttaatctatttttctctacatgggggcagcagacgaggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatg

SEQ ID NO: 4764 - DNA, 563 bp, Homo sapiens
  ENST00000511992
gagacacaagagtgggaagagtgcagattggagcagctatccaaaaatacagaaggccagaaggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatac

SEQ ID NO: 4765 - DNA, 5023 bp, Homo sapiens
  ENST00000359546
ggggttggcaacagagcaggtaggtagacctgcatttggttgctggtcacagaaatggagagtgagagatatttctaagtcaggatgccctagtggcagacccccaagtcctcgaacttcagggcagaactgcctgggtgggaactctcccatgtctccttgatttcactgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcagaatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggatcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtagaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccccgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagc

SEQ ID NO: 4766 - DNA, 565 bp, Homo sapiens
  ENST00000506642
agaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaagacagactggtggctttcagacagaaaggagctggaccagaaggctggaagatggattcggggcgtactgtgcaagacctttgccagagcctgagcaatttccatctctactcagctggatgggcgtggtgaataaattcattcagttcattgttgctccacagctaacaataaagctgggagctgggtccaaatggtgacttggctgtctaccagctgcttggccatgggcaacccccaccccctctgagccttggtttccgtatctgtaaaatgtacatgatgctccctgttggttgggtcagcctccccagtgttaccaagccacg

SEQ ID NO: 4767 - DNA, 469 bp, Homo sapiens
  ENST00000515502
cgggcgccctcgtcggccgcggaggagctgcagcctccaacagaagggaaaacggacacctgtggaggggaagaaacgtgtccaagatcattcacacagagcgtcagctctggggtcagaacccagctcccaaggctttccgtgtccagaccacctccctcacctggttggccagcctccacctgatgagccgggcaggctgcaagtggcaagttccctgggaaggtgtggtccctgccatgctatctgctctgctcagcgactgaaggtgcccgcatcccagctctgccaggaagcaaagttacagatgagaaaactgaagctcagagagtgaaaggacttgcctaaagacacacagctggttgtcacatcttcccaagccaggccagccaggagcgctgcatgcaaattctgccgtgggctaaggcacgctaaccagagccggcggcatggacttcgtcatgaagca

SEQ ID NO: 4768 - DNA, 557 bp, Homo sapiens
  ENST00000509837
agctggaggcggggagagccttgatcaaagtcaggcaggggagcacagcggcttcctgacgctggacccaggtggggacagagcggccctgtgaagtcaaagagaatgttgctttgttcagctctcactgggaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggag

SEQ ID NO: 4769 - DNA, 826 bp, Homo sapiens
  ENST00000393745
catctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccct

SEQ ID NO: 4770 - DNA, 518 bp, Homo sapiens
  ENST00000512824
agaagccgcggctccagctcgcctggcggaattgcacgcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataaggactgaggcttgggaggcactcctggccacctcagccagtgctgcatgatcatgagactcctgctgtctccttgcccaccccgcttcatgcgcgt

SEQ ID NO: 4771 - DNA, 970 bp, Homo sapiens
  ENST00000514150
agtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaaaggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacgg

SEQ ID NO: 4772 - DNA, 532 bp, Homo sapiens
  ENST00000502265
agacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaa

SEQ ID NO: 4773 - DNA, 567 bp, Homo sapiens
  ENST00000515025
aatctccgccggagccggggaaaggtggcattgccatttctctcttagagaggaggaaactggggactcgagcaggttagggccttgctgaaggtcccatggcaaataaggaaatgacggtggcgttggaaaccagatctgcctgactccaagttccaggctctttccaatgctcctggcttcaatcaaatctgaacaatagggtcaagatgaaggctttaaaatagggaccaaaccgctttcaaaaagctatttggcagcacctacgtgtctgcccagtaaatcgctctcttccatctcctttctcctccagcagggcattgggtcttgacctcagagcgatgggtgcctggtgtctgaaccagggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggca

SEQ ID NO: 4774 - DNA, 576 bp, Homo sapiens
  ENST00000515094
aatctccgccggagccggggaaaggtggcattgccatttctctcttagagaggaggaaactggggactcgagcaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcct

SEQ ID NO: 4775 - DNA, 2082 bp, Homo sapiens
  ENST00000395018
ggcgggcccgggcgggggcgggcggcgggcggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaa

SEQ ID NO: 4776 - DNA, 697 bp, Homo sapiens
  ENST00000546556
tcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaagctgcgttcctttgcctgcaacaggggtcaagatgagttttgcctgacttctttgatgtcctgaactttccgtagtcctttttcttgaatttgttcattataaatatagcttggcatttgtttgatcttttcaa

SEQ ID NO: 4777 - DNA, 655 bp, Homo sapiens
  ENST00000551897
acccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaagctgcgttcctttgcctgcaacaggggtcaagatgagttttgcctgacttctttgatgtcctgaactttccgtagtcctttttcttgaatttgttcattataaatatagcttggcatttgttt

SEQ ID NO: 4778 - DNA, 6655 bp, Homo sapiens
  ENST00000551568
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttggttattactttcaattgaaagttctatgggatctagaaatgagacatactggcatggagagtgagaacgacaaaggaatgaagagctacaggagcatttaggccatttctatgccaagcttattctacatgcacaaaatcatacatgttaataaatataaacaaattggaggcttatttaaaccaattatgaaatctggtaatttgtgcagcagcaatagatgataaccaaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatggtatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaaaaaaagaaaaaagaaagaaagaaaaaaggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatctgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccatataaa

SEQ ID NO: 4779 - DNA, 2116 bp, Homo sapiens
  ENST00000546373
gtctagattcttcttggcctctctgagcagcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctc

SEQ ID NO: 4780 - DNA, 563 bp, Homo sapiens
  ENST00000546912
atgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtttgtaaaattttcttattaattccctattaatacaaaatagagcatctggcaagacctctgggttgact

SEQ ID NO: 4781 - DNA, 794 bp, Homo sapiens
  ENST00000548954
gctataacacccggccccgccgggcggccgcgggtgggtagagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttccta

SEQ ID NO: 4782 - DNA, 703 bp, Homo sapiens
  ENST00000551728
gctataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaat

SEQ ID NO: 4783 - DNA, 536 bp, Homo sapiens
  ENST00000547134
ataacacccggccccgccgggcggccgcggaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttg

SEQ ID NO: 4784 - DNA, 550 bp, Homo sapiens
  ENST00000547924
gggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaaggtaaagaggggctggtctatctttacttgaaaacaacacaacacaaaggctcccgacaggcacctgttggccttggcaagaggagatgtg

SEQ ID NO: 4785 - DNA, 454 bp, Homo sapiens
  ENST00000548262
gggtgggtagaggtgcgcgcctgggacctggtgaggctggggaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctg

SEQ ID NO: 4786 - DNA, 243 bp, Homo sapiens
  ENST00000549781
agaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaagaaacctgtgggttcttgttgtggggcggtttccaaaggaacacagaattgggattcca

SEQ ID NO: 4787 - DNA, 527 bp, Homo sapiens
  ENST00000549691
gtgcaatggcgtgctctcaactcactgcaacctccacttctccggttcaagtgattctcctgcctcaacctgctgaatagctggtattacagcgacacgccaccgcgcccagctaatttttgttatttttagtagagatggggtttcaccatattggcctggctggtcttcgaactcctggcctcctgtgatccgcccacctcagcctcccaaagtattgggattacaggtgtgagccactgctcccagtcttttttttttgtttaatgaactagaatggaagggaaaagaaaagagcattgcaagatggagtgaggaaacccagcaaggcctgtctgtctagattcttcttggcctctctgagcagcatttcttccttctgcgtatgggacaggaccctttctggaatgggggtcttatgacctacaatcaaacaagtatctaacatccaattaaaagaggagtcatggctcaatcctcaagaaagaaacatgattatatggagtctttgccttatgtggacacag

SEQ ID NO: 4788 - DNA, 6636 bp, Homo sapiens
  ENST00000338356
ccctcatgtgttctcaggttcttcttatttttattcatctctagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttggttattactttcaattgaaagttctatgggatctagaaatgagacatactggcatggagagtgagaacgacaaaggaatgaagagctacaggagcatttaggccatttctatgccaagcttattctacatgcacaaaatcatacatgttaataaatataaacaaattggaggcttatttaaaccaattatgaaatctggtaatttgtgcagcagcaatagatgataaccaaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatggtatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaaaaaaagaaaaaagaaagaaagaaaaaaggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatctgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccat

SEQ ID NO: 4789 - DNA, 3556 bp, Homo sapiens
  ENST00000617767
attccaggatttcacttgtcacactgatgggtgagatgcctttcatattggcataagacactgagcggatgcctcctcttatcttatcaaacagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattcttct

SEQ ID NO: 4790 - DNA, 4184 bp, Homo sapiens
  ENST00000429747
gctcctgccatacgccagacagttttgtagacacgaaggatccagagattagcaacacctttaccatttttggtgacagttaagcacccatctaagaagttttctttggtgagtgccaaaaagtgtaactcccattccccccacacccgcgccgcgatacgaccgctccaccctagagtggagatggagaccaagcacttggagatctaaatcaagtgtccccaggagctcagttgagcgacaaagctgagcagaaagcccagactgcgggcgcggcaggaccacggagagcgccgccgccaaggcctgggcggggcctgagctcgggttcccggggcaatgctcgtctccgtcagcaacccccagggggcgctcgcgcggaggtttcggaaccagtctcttgccgggttgctgggtgcatgggattcgtcagaaggtggaaatctctctgtgagaagctgccatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattcttct

SEQ ID NO: 4791 - DNA, 561 bp, Homo sapiens
  ENST00000505881
agaagggtacaaatcttttttctttctccaaggagaatcttttgagcacaatgaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaag

SEQ ID NO: 4792 - DNA, 2503 bp, Homo sapiens
  ENST00000511604
gagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattaca

SEQ ID NO: 4793 - DNA, 2230 bp, Homo sapiens
  ENST00000512332
gagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgcta

SEQ ID NO: 4794 - DNA, 700 bp, Homo sapiens
  ENST00000503204
agaacagaagtgtatttggctcatggttttggagtctgggaagtccaagagcatagcaccagcacctacaagggtcatctcatggcagaagtatggaaggcacaagcaaacatgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatg

SEQ ID NO: 4795 - DNA, 2312 bp, Homo sapiens
  ENST00000514439
gggtctcacagaatgaggctttgaagcctgtcctcctaactcttggcctgctgctctttctttgtaactgtcagtgaggtagttattataattaagctataattgccatgcctacctttaagctccattcatcagaaccctaagcctttaggactatcagcacattcaaaaaatgtctgtcatcactgttgctttggtcaatgtgcagtgaggccacctgggtgtctaactggtattgtattgtccttgtctccctcacctcttcacccccccccatcatcatggggcatctgactgcagcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattcttctaagagtt

SEQ ID NO: 4796 - DNA, 318 bp, Homo sapiens
  ENST00000505331
tccaaagttaccagaggaaggctgaattttatgaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttggtgagtgccaaaaagtgtaactc

SEQ ID NO: 4797 - DNA, 447 bp, Homo sapiens
  ENST00000506687
ctggaaataagaaaagctctgagggtctccaaagttaccagaggaaggctgaattttatgagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggtttccggagagaccgaactctgctctcagcacctttcccagc

SEQ ID NO: 4798 - DNA, 577 bp, Homo sapiens
  ENST00000505957
atcaaacagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccag

SEQ ID NO: 4799 - DNA, 550 bp, Homo sapiens
  ENST00000514999
gttggagagccagtgacatcccaggcttttgcccaaatgtccttgagttctacaccctgagccttgaaatgcagcttttctggggctgacttcccaggatcggtggtgctgtactttcaggagatggtgtttgctggccagtgaagcacaaaatcagagtgaatgtggttcacatacagctttatgtaggtgcatcaacgagcctggaactaggtgccgggtgccctctaagacaccaagagctattttggaaatagaaagggaacaagtatataaaaatggaagatccagaaatacaaggaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggactt

SEQ ID NO: 4800 - DNA, 2120 bp, Homo sapiens
  ENST00000502818
aatgctcaccctgactcattcagggaaggatccaaggtttttgatgcagggcactgactctctgcctgtttttccccttcatcatctgctccccttaaaaaatggtatcaactgcattgaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctga

SEQ ID NO: 4801 - DNA, 1958 bp, Homo sapiens
  ENST00000515418
ttgcaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaa

SEQ ID NO: 4802 - DNA, 5431 bp, Homo sapiens
  ENST00000512055
acaccagcggctggacattgagaggatcacagcagtggaaaaagacacaagcacctagccgttgagaggaacgcactggcctaagaacatactgacagacgccggtaggccagcagggcggcaggccatcaacccgcggaaggacacggactttggccagggcggtataaggagcctaaaggacgtcatacccatgggccagacctaacattcctttctgctgatcccaagtttttagacaaagtttcccttccttaaccaattgcgaatcagaaaatcctcgaatccaccaatgacctataccagtaaagatgtcatctggccaatttgtgtgaaaaaagagaataattctcatccaaaccgcctgtctctggaaataagaaaagctctgagggtctccaaagttaccagaggaaggctgaattttatggtgattgataatatttccaagcttatggagaaaaaaatatcattagtcttttccatggtagaaaagagtaaagcctgtaacaaaaaaagtgatacagtggatgggatgatgagacccttgaaataagcaaggatggaccagaaactggtaacactcacccatggaatttcattatgaagtcgtggcaagggccaagccgacctggatttgaaacccatctcttcaacgatgtagattttgacaacatatttgatttctctgggcctcagtttgttatctgcacaaaagggagatatgagtggttacgttattggattgtcatgaacattaaataggataatgtcaaatcattcagccaagtttctagcatatagtacaggttcaaatattatcttttttttcccaccaacctcttttccaggaaaatgcaaagctactctttagccaaattttaaaacaggggatatttattttgggaatcattaatacccatctgccccttttttggtccattggacatattgaaatgaatgattaatacttatcacttcatggtgtacacattgttttgtttcttatatccagagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttggtgagtgccaaaaagtgtaactcccattccccccacacccgcgccgcgatacgaccgctccaccctagagtggagatggagaccaagcacttggagatctaaatcaagtgtccccaggagctcagttgagcgacaaagctgagcagaaagcccagactgcgggcgcggcaggaccacggagagcgccgccgccaaggcctgggcggggcctgagctcgggttcccggggcaatgctcgtctccgtcagcaacccccagggggcgctcgcgcggaggtttcggaaccagtctcttgccgggttgctgggtgcatgggattcgtcagaaggtggaaatctctctgtgagaagctgccatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacaaaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattct

SEQ ID NO: 4803 - DNA, 2657 bp, Homo sapiens
  ENST00000268720
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagccagcccaaaagtggcttctgcaagtcgtgatgagagtgtctgttgatgtgctgggccctgctggacactgcgctaagcacttcctgtgctgcacggaatcctcacaccttgccaggacgggtccttcttttttattgaggtatgatgacctctgcctcccctgggcgactgctggcgccgtgaggtggtggacgtgcaggggtggccacacgcagggatggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctatccttgta

SEQ ID NO: 4804 - DNA, 576 bp, Homo sapiens
  ENST00000525982
ttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcaggtatgatgacctctgcctcccctgggcgactgctggcgccgtgaggtggtggacgtgcaggggtggccacacgcagggatggcagattgtggcccagaagaag

SEQ ID NO: 4805 - DNA, 2409 bp, Homo sapiens
  ENST00000319518
gcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctatccttgta

SEQ ID NO: 4806 - DNA, 550 bp, Homo sapiens
  ENST00000532500
cgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccacaaaacgtgaacgaggagaaactggagtgagcgtttgagtgaaccagccacagtctctacgtgtcatccaaggagcccggcacagaccccgtgtcacccccatgtcacccgcagaccccgcgtcacccatagatacgcacaccccgtgtcacccccatagcacccccgtgtcaccc

SEQ ID NO: 4807 - DNA, 519 bp, Homo sapiens
  ENST00000529800
ttccacagggtgtactccttcctggactatatcatgggcggctgccagatccacttcaccacaaaacgtgaacgaggagaaactggagtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacaca

SEQ ID NO: 4808 - DNA, 682 bp, Homo sapiens
  ENST00000568977
gacagtgacaagaggttttccgctttggggtttggagcccggatccctcccaagtatgaggtgtcccatgactttgccatcaatttcaaccctgaggacgatgagtgtgaagcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaa

SEQ ID NO: 4809 - DNA, 672 bp, Homo sapiens
  ENST00000566398
cagctgagccctcggtccctctcctggacacgaagctcccgccctagtggggccccacgcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtgg

SEQ ID NO: 4810 - DNA, 488 bp, Homo sapiens
  ENST00000526232
gttcgtgcccttccgggagctcaagaaccagagaacagcacaaggggctcctgggatccaccacgcggcttcccccgttgctgccaacctctgcgacccggcgagacacgcacagcacacacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagcc

SEQ ID NO: 4811 - DNA, 517 bp, Homo sapiens
  ENST00000564421
aggactttgagcacctgaaacaccctccaccgttttgaaacttgtcgaatctacacaaaagcagagaacagcacaaggggctcctgggatccaccacgcggcttcccccgttgctgccaacctctgcgacccggcgagacacgcacagcacacacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctg

SEQ ID NO: 4812 - DNA, 552 bp, Homo sapiens
  ENST00000552259
ggtgataaagactaaaatggattggacagaacttaaaagtaaaatatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagaactgtgaaattgaatgaaaagaggccaacagcttctctctacctgctctcagggataattaccagaaaaatggtcaaaaggctgacagcagcaggggagaagagattcataaaccttcaatacaatctgatagcctgttggtcttgactcaggacagactgaggagaaagtgttcacaagatgccaggatcttatgtcagctctgaaatttcctttgactaaacatgctaaacaaaacaatacaaaacaaaacaataaaaaagattatttt

SEQ ID NO: 4813 - DNA, 3489 bp, Homo sapiens
  ENST00000331366
accctcaacccccatccccgcctgacgggagctagccctcagtccgcccgagctgtggttgtgggcgccggacaagtccaaggcgcctcctcccaatatggacagccgctacaacagcactgcgggcatcggggacttgaaccagctgagcgctgccatcccggccacgcgggtggaggtgtccgtgtcctgcagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgaggtggtgaatcccaaaaagaaaggaaaaaagaaaaaatatactaattctggaacagtaactttactctctttcttggtagaaacagaagtttcattccttgactacattaagggagggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagttaatgctttgtgcctggtgctctgtaatgaaccaggcaatgagatagttttctcagtttggtttcagcagttaatgtgctttcttggatccaaatttaaatatcttcctaaaccaaaactgtaaatatggttgttgcatgagcaacagaaaaaattgtttaaatgcttgaagcaaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcaatgttatataactatgtaataattgttgatttttaattatgtattaaaatctttaaatcataactatttgctttgtacgtttcatgtatgaatgacaatagtttgatgatttcctttactgatcttaaatatttatgccactacagtgtattacctacagatttttaaatttagctttatttatcaacccaaaaaacaaataaataagatcaatattcttttcttcttgtcaaaca

SEQ ID NO: 4814 - DNA, 2875 bp, Homo sapiens
  ENST00000538596
aaagtgctcagcagaaaggaggccctagagtgggtagctcctttctgctgctggtcaaccccatccttaccaggcatccatcccatcggcccaggaatctgtctgcctcctgctgctcttcttggcacctgggctcagcactgactttgctccaagattagagcggaagccaacagcagggagaagccaggcagtgggagtaggcacttctgagcctgtgagggcaggagctcttcctgggcccccaagggtacagggatgcctgagcttgcagctgtggtttgggcaactgcagctgtgtggggaaatgcgagggggcagctcctgcctgctccatggagcaggagtggcctgggaggtctgagtctgtagccgtggcttggatgactgcagtgcacctggggagctcctaccccaactcggaaaaggcagagctcccacttgtccctggctcccacacgctccccggagcatgcagccccggctgtgcctccttgctgcagccagcgtgatggcagcgtaaggctgtctggagcagctgctgccatcaatagttgataaagaaataaggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagttaatgctttgtgcctggtgctctgtaatgaaccaggcaatgagatagttttctcagtttggtttcagcagttaatgtgctttcttggatccaaatttaaatatcttcctaaaccaaaactgtaaatatggttgttgcatgagcaacagaaaaaattgtttaaatgcttgaagcaaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaatatatacaactatgtgacttagtgcacaacacatttgtgaaataacctactcctatatactgacctgcctgtccacgaataattgtaaagggtttttgcatgtacagtttttacaagaattacagttttgtgaagttgtgtctaaattaaagcatttctttagaacaaatggccttaaattctcacggaattcctggaaatgattgtgaattgccttcaaataatagaaaagtgtatttatttgtgtgtgtgtgtgtgtcaaaaatgtaactgctttataatattttttccttacctatatattctatttaatacttggtttatttctactgtacattgttttctttgtcccaagttgacctagggtgacttttataagcatgaaactattttactggaaagaaaaatatatacatccacatatctaacagtatcaatgttatataactatgtaataattgttgatttttaattatgtattaaaatctttaaatcataa

SEQ ID NO: 4815 - DNA, 1036 bp, Homo sapiens
  ENST00000546603
gaacaagtgccaaagaagcaacaactggttttaaaagattaatttgtggtgccgaaggtgataaagactaaaatggattggacagaacttaaaagtaaaatatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagttaatgctttgtgcctggtgctctgtaatgaaccaggcaatgagatagttttctcagtttggtttcagcagttaatgtgctttcttggatccaaatttaaatatcttcctaaaccaaaactgtaaatatggttgttgcatgagcaacagaaaaaattgtttaaatgcttgaagcaaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactg

SEQ ID NO: 4816 - DNA, 1757 bp, Homo sapiens
  ENST00000360449
ggtgatggcttcacagggagatacatgagtcaacatttatcgaatgatggatgcactttaagtgcagttcattatatatgttatacctcactgaagtggaaacaaattggataaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgaggtggtgaatcccaaaaagaaaggaaaaaagaaaaaatatactaattctggaacagtaactttactctctttcttggtagaaacagaagtttcattccttgactacattaagggagggacgcaaatcaatttcacagtggctattgattttacagcatcaaacggcaaccctgctcagcccacttccctccactacatgaatccttaccaactgaatgcctatggtatggcactaaaagcagtgggagaaattgttcaagattatgacagtgataaaatgtttccagctctaggatttggtgcaaaactgcctccagatggaaggatatctcacgaatttgctttgaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctatatgagagcccgaggaatcaagccatcacctgcgcctcccccatacaccccacctacacatgtgttacagactcaaatatgactgtgctctgaaatgctaatgtcaactacaaatcaaaagtgctgagtt

SEQ ID NO: 4817 - DNA, 376 bp, Homo sapiens
  ENST00000547417
tttctttgtctgtaaaatgcacacttaatcaagttttgtatgagaaatgaatgaagacatgaagggatcaacatgctttctgtcttttcatagcacattttgctacttcatacatcttgatttccttgttgtccacattgttttagtatttggctaaaatgtactgaataaatgatcatattttctcttaaagcaatggtcgaattggatggagatgatgtaagagtctcctctagaggaaaatatgctgaaagagacattgtgcagtttgtgccattcagggattatattgacagaagtggaaaccacatactgagcatggctagattggctaaagatgtcctagctgagatccctgagcagtttctctcctata

SEQ ID NO: 4818 - DNA, 412 bp, Homo sapiens
  ENST00000549842
atctctttcaattgatcttcatggagatttacttttttactgttgttttgttttgttttgcctataaatttctacagaatgggaatcctcaaaacccctactgtgatggcattgagggggtcatggaggcttattacaggagtctgaaatctgtacaactatatgggcccaccaactttgctcctgtaattaatcatgtagcaagatatgcttcttctgtaaaggatggctcccagtattttgtgcttctgattgttacagatggtgttatctcagatatggcccagactaaggagtccatagttaatgcctcaaaacttccaatgtcaataattatagtaggtgttggaccagcagaatttgatgcaatggtcgaattggatggagatgatgtaagagtctcctctagagg

SEQ ID NO: 4819 - DNA, 542 bp, Homo sapiens
  ENST00000551855
tgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgagagtgcttgttcctcaaattatctggaagaattgcggaattcttcaaatctcaagatcaaacattacctttctcctccaaacaacctgctccatatttaatagaataaccattgaaccatctgaaaaatttgtgatcttgccagtgacgcccaacatccttactggtgcatgttttcctgtagaatttgttcaattagggctttctgaaatacacaataaataatacgtggaatgaa

SEQ ID NO: 4820 - DNA, 549 bp, Homo sapiens
  ENST00000550863
cacaatgccccaccgtccccaactctcaagtggccgacagtgggcagtccagaagctgggaccagactcatctgcccgagggcacagtaggagggacggagggatctcccaagagctccgagggcgagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggac

SEQ ID NO: 4821 - DNA, 2068 bp, Homo sapiens
  ENST00000383832
atctggagccgctgccgccggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccgaaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcagttcgtcccattccgagactatgttgaccggtcggggaaccaggtgttgagcatggcccgactggccaaggatgtgctggccgagatcccggagcagctgctgtcctatatgcgcaccagagacatccagcctcggcccccaccccctgccaaccccagcccgatcccagctccagagcagccctgaggattccacatatccaatgcctcacagtctgcaagcctgctcacccactgcttctgctttaagccagaggcacctggaaccctggacttcactgggagggccaacttggaggatcagtgctggctgacaagccctccgcctccttgcctgcagagggcctggcactatcaccacctctctgccttcatgccaataataaagctgatctttattcca

SEQ ID NO: 4822 - DNA, 1751 bp, Homo sapiens
  ENST00000383831
ggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccgaaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcaggaaggttgctgcagccttggcacatccgtggtgtaggtcgggaggtccccaaggcccctgccctctagtggagacaaccaacaataaataatcacacaaagaaa

SEQ ID NO: 4823 - DNA, 584 bp, Homo sapiens
  ENST00000491802
actgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccagtaggcggctccaggaccgggagggggaacttggggtctgggcgcgactcaggggcgggtggagtcggggccaggggtgggagccgacctgacgtccttccctccccgcccccacctgcagtggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtgaggccccgcctggaattctggcttggcccgcccccg

SEQ ID NO: 4824 - DNA, 588 bp, Homo sapiens
  ENST00000273027
ccagaaccagttcacagtatatgaggttcttaaccctcggaagaaatgtaagaagaagaaatatgtcaactcaggaactgacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagcca

SEQ ID NO: 4825 - DNA, 1742 bp, Homo sapiens
  ENST00000613455
ggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggaacctgctagaccttgataccttctccaagtccgaccccatggtggtgctttacacgcagagccgggccagccaggagtggcgggagttcggacggaccgaggtgattgataacacgctgaacccagacttcgtgcgcaaattcgtcctcgactatttctttgaggaaaagcaaaatctgcgcttcgatgtgtacaacgtggactccaaaaccaacatctccaaaccggaggatttcctgggacaagcgttcctggccctgggagaggtgattggaggccagggcagccgagtagagcgaaccctcacgggtgtaccaggcaagaagtgtgggaccatattgctgactgcagaagagcttagcaattgtcgggacattgccaccatgcagctgtgtgcaaacaagctggacaagaaggacttctttgggaaatcagaccccttccttgtgttctacaggagcaatgaggatggcacgttcaccatctgccacaagacagaggttgtgaaaaacacgctgaatcctgtgtggcagcccttcagcatccctgtgcgggctctgtgcaatggagactatgacagaacggtgaagattgatgtgtacgactgggaccgggatggaagccacgatttcattggtgagttcaccaccagctaccgggagctgagcaaggcccagaaccagttcacagtatatgaggttcttaaccctcggaagaaatgtaagaagaagaaatatgtcaactcaggaactgtgacgctgctctccttctctgtggactctgaattcacttttgttgattacatcaagggagggacacagctgaacttcacagtagccattgacttcacggcttccaatgggaatcctctgcagcctacctccctgcactacatgagtccctaccagctcagcgcctatgccatggccctcaaggcagtgggagagatcatccaggactatgacagtgataagctcttcccagcttatggctttggggccaagctgcccccagagggacggatctcccaccagttccccctgaacaacaatgatgaggaccccaactgtgcgggcatcgagggtgtgctggagagctatttccagagcctgcgcacagtgcagctctatgggcccacctactttgctcctgtcatcaaccaagtggccagggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcaggaaggttgctgcagccttggcacatccgtggtgtaggtcgggaggtccccaaggcccctgccctctagtggagacaaccaacaataaataatcac

SEQ ID NO: 4826 - DNA, 2091 bp, Homo sapiens
  ENST00000265394
gtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaagtgagcttttgtttttggggggagatgtttactacaaaattaacatgagtacatgagtaagaattacattatttaacttaaaggatgaaaggtatggatgatgtgacactgagacaagatgtataaatgaaattttagggtcttgaataggaagttttaatttcttctaagagtaagtgaaaagtgcagttgtaacaaacaaagctgtaacatctttttctgccaataacagaagtttggcatgccgtgaaggtgtttggaaatattattggataagaatagctcaattatcccaaataaatggatgaagctataatagttttggggaaaagattctcaaatgtataaagtcttagaacaaaagaattctttgaaataaaaatattatatataaaagtaa

SEQ ID NO: 4827 - DNA, 1739 bp, Homo sapiens
  ENST00000396276
agcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaa

SEQ ID NO: 4828 - DNA, 679 bp, Homo sapiens
  ENST00000432534
aaagtacttccagaagcagtgccatgaatgcatagaacacatcaggaagcagaactggtttgaggcctttgaagaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaa

SEQ ID NO: 4829 - DNA, 561 bp, Homo sapiens
  ENST00000455893
attatagggggctatgcagaattcctgtaccaaattggcttgttggatgagaagcaaaaaaagtacttccagaagcagtgccatgaatgcatagaacacatcaggaagcagaactggtttgaggcctttgaagttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttg

SEQ ID NO: 4830 - DNA, 2213 bp, Homo sapiens
  ENST00000409850
gctcctttcgcttttcgctcgctgcactccaagccccggaacacccgcgtccgcacactaagggcaccaccgctctcccacctctgcgctgtcagatgtcaggcgcggaggtgctctgggcaccgaggtgctggcgaaccaaacaagtatcaccccggacgcctgcccccattccgagagagcgggcgggatggccacaggctgcaatacagtgacacgatcacagctcactgctacagcctctacctcctgggcttaatccatcctccctcctcagcctcccaagcagctgggactacaggtgattttgatatgctgctaaggtttgataagagaaatgagattcagagaacagattatattgttgaagagcttgactggaaatgatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttg

SEQ ID NO: 4831 - DNA, 874 bp, Homo sapiens
  ENST00000448959
atctaatcactccatttcatccagactgagatagatggctcacatttttgttgttattgttttctgtaatccttgggtaaattttttttcccccactaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattacta

SEQ ID NO: 4832 - DNA, 525 bp, Homo sapiens
  ENST00000458405
aaaagacttgactgcatgataagaagacaccagcatatgaggcacagcctcattcaaagaaccaaagatgatcagtactttgctcatagtggagagtggttactgaggtctggggaggttttgtaggatttagtcacagccctgtaacacagagaggatttggatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcat

SEQ ID NO: 4833 - DNA, 553 bp, Homo sapiens
  ENST00000447426
gactcactctagttgaaagccctgggggaaggaacaaactctgcagcctgactgctgtgtttaatcccagctctcctctactagctggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagc

SEQ ID NO: 4834 - DNA, 696 bp, Homo sapiens
  ENST00000488891
acacccgcgtccgcacactaagggcaccaccgctctcccacctctgcgctgtcagatgtcaggcgcggaggtgctctgggcaccgaggtgctggcgaaccaaacaagtatcaccccggacgcctgcccccattccgagagagcgggcgggatggccacaggcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgacct

SEQ ID NO: 4835 - DNA, 528 bp, Homo sapiens
  ENST00000449801
gtcagatgtcaggcgcggaggtgctctgggcaccgaggtgctggcgaaccaaacaagtatcaccccggacgcctgcccccattccgagagagcgggcgggatggccacagatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctggga

SEQ ID NO: 4836 - DNA, 571 bp, Homo sapiens
  ENST00000455544
aaacaaagaaaatcaagtctgcgaggagcgagggtttgctcccctctgctccggatttgggtgtccagggtagcgggcgcggcacggcaaacaggtgattttgatatgctgctaaggtttgataagagaaatgagattcagagaacagattatattgttgaagagcttgactggaaatgatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatt

SEQ ID NO: 4837 - DNA, 524 bp, Homo sapiens
  ENST00000437527
aaagaaaatcaagtctgcgaggagcgagggtttgctcccctctgctccggatttgggtgtccagggtagcgggcgcggcacggcaaacaggtcggggcgctctgcttcaccccaaccttctccgccccgccagcccccgctccagctgcgccagaaagtgcgagcctgcccgctcctttcgcttttcgctcgctgcactccaagccccggaacacccgcgtccgcacactaagggcaccaccgctctcccacctctgcgctgtcagatgtcaggcgcggaggtgctctgggcaccgaggtgctggcgaaccaaacaagtatcaccccggacgcctgcccccattccgagagagcgggcgggatggccacaggcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaa

SEQ ID NO: 4838 - DNA, 2687 bp, Homo sapiens
  ENST00000621158
cagagaggaaagtgacagaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccccgcgcgccccgcgccccccacccggggccgcgccgcctccgtccgcccctcccccggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatcaa

SEQ ID NO: 4839 - DNA, 561 bp, Homo sapiens
  ENST00000534787
ggcgcgctgaggctgcttctggtcagggaaaccattctcctacaccgaccccagcaggcagctgcgcccccagagctttaccctgtctctgcactgaccttggggaaggaatttagggaggggtaaaacaaggctagagctggtaccattactgccccgggagagtcccctctgccgccaccagagacagccaccaaagcgccccacgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgc

SEQ ID NO: 4840 - DNA, 438 bp, Homo sapiens
  ENST00000527342
tggcagtccgtgtcccacaatgtcagggctggtgcaagctcatgctcagctgaactcatgatgtccaagtggagctgatgtgcaacgttgctaactcggtttcccctgctctccccagaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccag

SEQ ID NO: 4841 - DNA, 528 bp, Homo sapiens
  ENST00000530518
atctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacagcttctccagcgggatccagccactcctctgttccctgattggcctggagaatcccacctgaccccccaccccacccctctgtctctggctggggttcctttctggcccaaagtaggtccaagcccttgtagttatttcgccacctgctgtacattgtgggaactgcaacccctacgtgcccgtttgggtggagagagattaaacatttgcccaccaa

SEQ ID NO: 4842 - DNA, 765 bp, Homo sapiens
  ENST00000534616
gagactgatgtggagatatataaataaacgaagtgccgtgataaaagcaaacacagcaataaagcaaaaatggctgggcacggtggcccatgcctgtaatcccaacactttgggaggccgaagcgggtggatcacctgaggtcaggagttccagacaagcctggcaaaaccccgtctctactaaaaatacaaaaattagccggcatggtggcgcacgcctgtagtctcagctagtcaggaggctaaggcaggagaatcacttgaacctcggaggcggaggttgcagtgagtcgcaaacgcaccactgcactccagcctgggtgaaagagcgagactctgtctcaaaacaaaacaaaacaaaaaacctaacaaaaacaatagctaccatttactagacactcactacataccaggcactgtgccaaacagctccttcttatcagctcagggtgctgggggtgccagggagggaaggtcagtgaaactgtggcaggtgtcggttaagcaaaagaaggctggcatctgtgcagctgggggcaggccttccctcctccaacccccttggccaggagcatcacagggcaggcctgagcttccacaaggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacgggg

SEQ ID NO: 4843 - DNA, 1817 bp, Homo sapiens
  ENST00000616094
aaaaatacaaaaattagccggcatggtggcgcacgcctgtagtctcagctagtcaggaggctaaggcaggagaatcacttgaacctcggaggcggaggttgcagtgagtcgcaaacgcaccactgcactccagcctgggtgaaagagcgagactctgtctcaaaacaaaacaaaacaaaaaacctaacaaaaacaatagctaccatttactagacactcactacataccaggcactgtgccaaacagctccttcttatcagctcagggtgctgggggtgccagggagggaaggtcagtgaaactgtggcaggtgtcggttaagcaaaagaaggctggcatctgtgcagctgggggcaggccttccctcctccaacccccttggccaggagcatcacagggcaggcctgagcttccacaaggtgacccagccagtcaccatgaggcaggccccaggcgccaggccactctgcagaggagccacgcaggaggtgacctttcctatcttgactgaaacgggcacctggcgtggaggccaagtctggagccagccccctaggagagctccaggaggcagagatgcctgcggggtcaaagcctgccagctgactgctgtgccctcctcaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaa

SEQ ID NO: 4844 - DNA, 7412 bp, Homo sapiens
  ENST00000330387
gtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagtaa

SEQ ID NO: 4845 - DNA, 2360 bp, Homo sapiens
  ENST00000456390
gtccctcaaagtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtgggtaagacagcatgtggcaagttgggcagggtcttgttttatttccctagagctgggtttctcagtcttccaaaaggaatcttctgtgaaagtccaatgtttaaaaagtggtaaaagtggagcttctccctttgaagaggcaagtgggggttcccctggggcccctcatccactggactgcggcatcactgggaattctccagagcttgacagagcacagtttgcaaactgctgttctagactgtgttccctgatccattctgacatctaatttttgagttctgataagggagagggaagcagatgagggaaagagtctgtcgctttctgtgacgttttaagagaactgctgtgtttctgcctccactgagtggaattgtatgagtaatgtaatgcaatgtatatagtaagggcttgtaaagtgaaattaaataaacagcaaggtcagggccgggcgtggtggctcacgcctgtaaccccagcactttgggaggccgaggcgggcagatcacgaggtcaggagattgagactatcctggctaacactgtgaaaccccatcgccactaaaaaatacaaaaaaattagccgggcgtggtggcaggtacctgtagtcccagctactggggaggctgaggcaggagaatattgtgaacctgggaggcggagtttgcagtgagccgagatcgcaccactgcactccagcctagacgacagagcgagactccatc

SEQ ID NO: 4846 - DNA, 1105 bp, Homo sapiens
  ENST00000452463
ggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaattttgcaagctaa

SEQ ID NO: 4847 - DNA, 776 bp, Homo sapiens
  ENST00000458726
gatgggcccactctggcccgatcctggcaccagcaatgggatgttgacctgtctgctgagtcttggagcccaccactgccaaggacacccagctggagctaatttgctgggctgagtcatagcatctgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaa

SEQ ID NO: 4848 - DNA, 719 bp, Homo sapiens
  ENST00000420629
aaccttccccgacgtccccggcgcctctcatccaggctgagcacagctactccctgtgcgaggagcctcgggcccagtcgcccttcacccacattaccaccagtgacagcttcaatgacgatatgttacataaatagtaaatggatgtacggtccgccctccctgtgcttgggttttgcatcctatgaatactgtattttcaatccacgtttatttgaaaaaaatctgcttgtgagtggacccgcatggttcaaaacccgtgttgttcaaggaccaactgcgtatgtgtttttctcatatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttc

SEQ ID NO: 4849 - DNA, 596 bp, Homo sapiens
  ENST00000468127
ggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacggtacatgtctgttgtgaacagctcattcctgtaaaatgctgctcatcattgctgcaagtcagtgcaacaaactgtgcatatgaattactgttgaaagaggtattggtttagcagcacaaatgattgggttatatttctctcaaactaaggga

SEQ ID NO: 4850 - DNA, 7133 bp, Homo sapiens
  ENST00000616381
acagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagt

SEQ ID NO: 4851 - DNA, 1053 bp, Homo sapiens
  ENST00000620715
cggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccaatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattc

SEQ ID NO: 4852 - DNA, 5912 bp, Homo sapiens
  ENST00000280527
gccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcaccgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatca

SEQ ID NO: 4853 - DNA, 667 bp, Homo sapiens
  ENST00000426856
tgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatg

SEQ ID NO: 4854 - DNA, 700 bp, Homo sapiens
  ENST00000428774
gcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctg

SEQ ID NO: 4855 - DNA, 386 bp, Homo sapiens
  ENST00000473403
ggtgcatattagcttaagaacttttaaacctctgcggcagtaatgagaatctgcatgccaagggcccagcatttctctacaaagcagcccatgagtgcatgtgtgtttgctgtagtgaagggtctatgttagaagctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtctctgtgttccagatttttttttgtaactatgaaatccttgccttgtagtcaacttaaaatgaaataaatttatcagtgc

SEQ ID NO: 4856 - DNA, 311 bp, Homo sapiens
  ENST00000477491
ctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggctggagtgcaggtgatcatatctacaaaggtgacaagaacatgaacctgcagtcctgttatcagcattttgtctctgtgttccagatttttttttgtaactatgaaatccttgccttgtagtcaacttaaaatgaaataaa

SEQ ID NO: 4857 - DNA, 240 bp, Homo sapiens
  ENST00000497236
ctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtctctgtgttccagatttttttttgtaactatgaaatccttgccttgtagtcaacttaaaatgaaataaa

SEQ ID NO: 4858 - DNA, 346 bp, Homo sapiens
  ENST00000481321
cctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacagtgagtagacagaagactgtatgttttttctgaggcctaatatgatattgtcaaagcatattatg

SEQ ID NO: 4859 - DNA, 874 bp, Homo sapiens
  ENST00000413985
gccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcataggaggccaaacctgattttgtaccctctagtggtcaaggatatgggggaagaccccatcacaagagggcccacctgataagaaccctctggagactgctggcagagtcttcttaacaggacttggactgtgaccagataaaacatcttctataggtgcagaaactggccaatctggaaggtccaatggcttctacgttaaggttttcttaacaagatggtataccccgacttttacatggattgcttcttttaagtcctaaaagaagttgtatttcttcctccttatttgggccaccttgatctttagttgtttctgcctgccttttaaaatgacatttttatatttccaaaatgatttat

SEQ ID NO: 4860 - DNA, 153 bp, Homo sapiens
  ENST00000619072
gcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaag

SEQ ID NO: 4861 - DNA, 181 bp, Homo sapiens
  ENST00000613124
tgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaag

SEQ ID NO: 4862 - DNA, 698 bp, Homo sapiens
  ENST00000619935
gccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaag

SEQ ID NO: 4863 - DNA, 1724 bp, Homo sapiens
  ENST00000486447
gcagcagatgtggatgtaatacagtgagcaggacccaaactcaaatgtttgctgaatgaatgaaggaaccagagtaagcaaagagggaaccagcaccggttaggccctggcgtgcccccaggacgcctgcagaagtgccacgggcatgacccggcccacctcgctacgcaccgcagcggagagaaggctcttccgagcggcacccagaggagccttcgcgggcatcgccgcaccttcaccggcagccccaccccaacccgggtccctcgggattctgcccgagcctacgccggcgcaagcgtgggcagcgaggaaccagctgagaggcaggatcaaagagcatgggagttgaagacaagggaaaactgggggacagaggcgaaaactcggatccgaaagggggtctgtccatcagggcacgccggaagagtggcgctgagctgacggcgagcgccggcgggtcggggcgccaaggctcagggctgcttcggcaattcgcgggggtagcttgcacctcgtgaggcgagacgccgagggcgtccagcggggcttacctaactctccctcccgcggaagggaagcggggaactactgcctcctaccatcaggtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctttgaagcaaaaaccaaacttttttttttttttttttacctcctgtcttgccccctaaaagaaataaatagagcaaacatcttgactctcc

SEQ ID NO: 4864 - DNA, 1953 bp, Homo sapiens
  ENST00000238892
gggagtatgggcttagaagccggaagtgggttgacgtagcccggaaggggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctttgaagcaaaaaccaaacttttttttttttttttttacctcctgtcttgccccctaaaagaaataaatagagcaaacatcttgactctccctttttaaaatttgtttgttttttttttttttttttggatacaagagctcactctgttgcccagggtggagtgcagaggtatcatcaggctctctgcagcctccatctgctgggctcaagcaattcttccccctcagcctcctaagtagctggggactacaggcgtgtgccactgtgctcagctagtttttatttttagtagagatgaggactcactatgttgcccaagctgttctcgaacttctgatctcaagcaatcctctggcctcagccttccgaagtgctgggatacaggtgtgagccacagaacttggcctctctcttttttttttttttttttttttttttttaacactacaggtttcaaatgaatacttttcttatgttgccttcagaggttcaggacttctgcttttaaaacctgcagcctaccgtgggaaaccaaaaaagcattccctatttccaactgcagtatgtataaatacatatcactacaaaatgtatagaaagtgtgatgagatacatgaatggcatttttattggtcataacattttgatgaaaagcatttaaagttttaactttataaggcttttcaaaatgtgtttttctgagatacattgttatttattcatatccagaaaaattacaaggataatacagaatataataaataatttatctgagagca

SEQ ID NO: 4865 - DNA, 4287 bp, Homo sapiens
  ENST00000262207
ggcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaagttttattttcagttccttttgcatgcctattttgatttagaaatcactttaagataaatgaacaaaattattgtaagtcttctaaacttggtttattgacgttagtataaataacatacaataccagatgtctacaaaatcgacctgattatttaggtatttgtatgtgaaagagaaacacatatttagaaacacagcaagggagattttgaataaagagagagatgaatttataaagtaggaaaaaaagaatctgaaagatacaaagtgattataaaagaattgacaggacaataaatacttcaaatacttttaggaagtaaatgagtaggagtttaggagggataaacgagataaattccatgcaatgatcaaggaaagcaagagagcagataatacaaaagaaaaagaagaaggttcacataaatagcttctggagtgcaaattataaagacatcaacatttttgatcatataataagtactggcttacagctaagtggttccaaatactggtaattaaaacaatgatgtatacgttaaagattgcaaaacttaaaagcagatttttatgggaacttttttcgaaaggatacatgaccaccttcttaaatagtatgactttacatagactctttttctggtccttactgctcctcccacaacagggaagcccgatcagttctgtcagtataaggttttcttctatttgcccttagtttagatctccatcatcaattccacttactattgtaataccttcagctggagcctgtgtctttctccattcctttttaatacattcgtatttcccagccccagaacccttgaaattaactcttccatgagttttcattgctgaagaaaaaccaaacattcttgtaaaaacatttaagaacttccatagtcttgttcatattgtttacctatcttctacacaaggcgtgtccttgggtaagttatttaacttcaatttaccttacctgtaaaatggaacaaataatatctccttaagattgctctacgaattaattgacacattatgtgtgatgtacttaaaggaataataaatgcataatatgaggtcagtggacgccattttctgttataatcatttttgttatctaatttggggaaactattcatctgtcatatactattgatcctttggcacttaaataaatgtgaaatcctccaggaattttcctgtgattctccttgtaagaattaaatgctctctaatatgatatccctttaa

SEQ ID NO: 4866 - DNA, 629 bp, Homo sapiens
  ENST00000519798
gcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatgacatgggatgtagagctggaaagatctgcagaatcctgggctgaaagttgcttgtgggaacatggacctgcaagcttgcttccatcaattggacagaatttgggagcacactggggaa

SEQ ID NO: 4867 - DNA, 553 bp, Homo sapiens
  ENST00000520277
agaaacgctggggcgcccaccctggcagactaacgaagcagctcccttcccaccccaactgcaggtctaattttggacgctttgcctgccatttcttccaggttgagggagccgcagaggcggaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgg

SEQ ID NO: 4868 - DNA, 2100 bp, Homo sapiens
  ENST00000523524
agaacgctggacaatccagtaaaggtgctgctggtaataaaacatgaaactatatcttatgcttggtcaagacgtgtcaaatctgtatctgaaatagtgaatgaatgagatcagatgttgtccagagaaggaaaatcaaatgataaaagtgttgagagaggggcagctcttgaaggaagatggaataagaacatggaaactcctgtgtggaaagaaaaggccaagaggtctgctaaatcaagagtactgtgaataaacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatg

SEQ ID NO: 4869 - DNA, 1964 bp, Homo sapiens
  ENST00000517786
aaaggtgctgctggtaataaaacatgaaactatatcttatgcttggtcaagacgtgtcaaatctgtatctgaaatagtgaatgaatgagatcagatgttgtccagagaaggaaaatcaaatgataaaagtgttgagagaggggcagctcttgaaggaagatggaataagaacatggaaactcctgtgtggaaagaaaaggccaagaggtctgctaaatcaagagtactgtgaataaacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatg

SEQ ID NO: 4870 - DNA, 4586 bp, Homo sapiens
  ENST00000262424
cactcgcatcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcctgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcaccgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccatc

SEQ ID NO: 4871 - DNA, 538 bp, Homo sapiens
  ENST00000566151
actcgcatcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagattgggtcttatccccaagatatctcattatgtacatgcaaatcagcggagcatcgtcatgacaccaggaggacaccccgtgacgccgattaccgcactctcaacctcaacccagcgtcagagttttctggcatctcttctttgagcctggccgcctgcagctggaaatgctcatatatggtggtgtgactaacctgagagagagagatcagggatcctgagaagttctgcattcttggtctgcttcccagtgggacgaagctcaagcgcccagctctgcccgaggagcccaggctgccccgtgagtcccatagttgctgcaggagtggagccatgagctgcgtcctgggtggtgtcatccccttggggctgctgttcctggtctgcgg

SEQ ID NO: 4872 - DNA, 2178 bp, Homo sapiens
  ENST00000567845
atcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcctgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatt

SEQ ID NO: 4873 - DNA, 1083 bp, Homo sapiens
  ENST00000566431
tcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagtcttggtgtgacccccgcctccagggagccttcctggacttcacagccagacagtgcacctgccccatgttcatcaacccccagactccttgggaaccttgatcgtcctgtcgtctcagctgccagctcactccagggcctccggaggcacatggcag

SEQ ID NO: 4874 - DNA, 1739 bp, Homo sapiens
  ENST00000565561
gggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatggtgagcgccggctccggccgcagaggctggcaccgggggtggggcctgggccaccagcctgctctgttccccagccagctctgttccccagccagtgcgtgtgatggctggctcagggtctcctctggcaggggaggatcccggctctgttctgttttgtttgtttgttttgagacagggtctcactctgccactgacgctggagtgcaatggcacaatcgtcatgccctgaaaccttagactcccggggttaagcgatcctgcttcagcctcccaagtagctggaactacaggcatgcaccatggtgcccagctagattttaaatattttgtggagatgggggtcttgctacgttgcccaggctggtcttgaactcctaggctcaagcaatcctcctgcctcagcctctcaaagtgctaggattataggcatgagtcaccctgtctggctctggctctgttcttaacattctgccaaaacaacacacgtgggttccctgtgcagagcctgcctcgttgccttcatgtcactcttggtagctccactgggaacacagctctcagcctttcccacctggaggcagagtggggaggggcccagggctgggctttgctgatgctgatctcagctgtgccacacgctagctgcaccaccctgacttctccttagcccgtgtgagcctcactttccacttggagagtccttcctcgcgtggttgccatgactgtgagataagtcgaggctgtgaagggcccggcacagactgaccctgcctccccaacccctaggctttgctaaccgggaaaggagctaacggtgacagaagacagccaaggtcaaccctcccgggtgattgtgatgggtgttccaggtgtggttgggcgatgctgctacttgaccccaagctccagtgtggaaacttccttcctggctggttttccagaactacagaggaatggaccacagtcttccagggtccctcctcgtccaccaaccgggagcctccaccttggccatccgtcagctatgaatggctttttaaacaaacccacgtcccagcctgggtaacatggtaaagccccgtctctacaaaaaaatccaagttagccgggcatggtggtgcgcacctgtagtcccagctgcagtgggactgaggtggaggtggaggtggggggtgggagctgaggaaggaggatcgcttgagcctgggaagtcaaggctgcagtgagctgagattgcaccactgcactccagcctgggtgacagagcaagaccctgtctcaaaaa

SEQ ID NO: 4875 - DNA, 1651 bp, Homo sapiens
  ENST00000564567
ctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatgtgagtaggatgcattttcaacaactatctcgcaaagcctgttaaagacctcaacatgcaagctccaagatctggatacttgaaactttattccagtgcctcttagctaaattaattaattaattaattaattaatttcga

SEQ ID NO: 4876 - DNA, 808 bp, Homo sapiens
  ENST00000569090
ccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtaagagccacaagttcctctccggctgccgcaggaccccactgccgtgtgccgggctcagcacttgtgccccttatcaagtttagcctgcaaagagagtgagagagaccacccgtcccatcgatattctgggaaactgaggcttggcatccaggaacactcctgagtgactgacaaaatgtattcaagcttggttggctgaccccagacactgatgattgattaaagtttgtagtttgggttttc

SEQ ID NO: 4877 - DNA, 1689 bp, Homo sapiens
  ENST00000569262
attgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcaggtaactactctgtgatcggggctctgtgaaacggttttcctgtttatgacggtgttgttgaaattttgaaaaataccacacaggccgggcgtggtggctcacacctgcactttgggaggcagaggcaggtggatcacctgaggtcaggagttcaagaccagcctgaccaacatggtgaaagtccgtctctactaaaaatacaaaagttagccaggcgtggtggcaggcacctgtaatcccagctactctcaggaggctacggcagaagaaccgcttgaggccgaggcagaggttgcagtgagctaagatagtgtcactgcactccagcctggccaacacagcaaaactccgtctcaaaaaaaaaaaaaagaaaacaacaacaacaa

SEQ ID NO: 4878 - DNA, 1123 bp, Homo sapiens
  ENST00000563066
cgggaggcggggagtgaagaacaaagagccgttccggagacctgggaggcattgcccatgggtcagggctacactggttttctggctgggctttctgtctttctccaagctctggacacaccgcaccgtgagaaaggctcctggaagcagagcaaccctgcccgggggctgtttctgaaggggcagagcagaggctggaaaacctgcaagccttccctcagagtcactgcgttccctcgtgccacgctcccctcctcttccaaacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgt

SEQ ID NO: 4879 - DNA, 615 bp, Homo sapiens
  ENST00000566789
tccgcctcctcggcctccctccctcccggctgcccgtggctgctcctggaattggccgctattcaccctcctcggcctccctccctcctacctgcccgtggctgctgctgtctccactggtgggtgaggggaggggctgggactgagtgagcggtttctgccctgcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggt

SEQ ID NO: 4880 - DNA, 590 bp, Homo sapiens
  ENST00000566165
caagacagccgtgcacgcgggagtcatcagcaacgagagtgggggtgacgtggacgtgatgcccgtggataaaaagaagacctacgtgggctcgctcaggaatggagttcagtctgaaagaaacatgtaaatcaaaccacaggatgaagttgacatttgcttgcagctcttgggccttttaaaaaataagaggagttccttttcctggcttcgaaaaggaacagcagtggtgatcataatggtcatcagaggagaaccatcccagcaacccagccacagctggtcttcactggacaccatgaactacaccgtccaaaccttcttcactcccgccaacagcagccgttcccctaactataagatgctcaaggaggagcaagaggtggctgtgctgggggcaccccacaaccctgctcccctgacgtccacgtgatccacatccacagcgagacctctgtgaccgaccatgtcatctggtccctgtttaacaccctcttcatgaactcctgctgcctgggcttcatagcatttgcctactccgtgaagtctagggacaggaagatggttgacgacctgaacagggcccaggc

SEQ ID NO: 4881 - DNA, 1020 bp, Homo sapiens
  ENST00000594325
gagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggggaaggcttcaacccaattcgtgaaggtatcaacacaggctagtttagcggcggaaggactcgtcagtatctcctgatggaataagtaccctttggcatcatcttgctagatccatcttccctgaaggcggtcccaccctcttccacggcagccaggtcctgatctgcacaggctgctcctgctgccagcctggatgggaagccatcccctacaacacacatgccttcctgtcgcagcctctctcctctctaactccaagctggagcacccaacactcttagcttccttctcaattacaccaaaactctccagaccccacttcttgccttgaccccaaaccacgaacatcacttagtatctaccaaccacctgccaagcattgttcacatataaaagttgacttaaaaagacaaagaatcgaccgggcgcaggggctcatgcctgtaatcccagcactttggaaggccgaggcagacggatcatttgaggtcaagagttcaagatgagcctggctaacatggtgaaactccgtctctactaaaactacaaaaatcaactgggcgtggtggcaggcgcctataatcccagctactcgggaggctgaggcagaagaatcgctcgagcccgggaggtggagattgcagtgagccgagaccgcaccactgaactccagcttaggcgacagagcaagactccatctgaaaaaaatacaaatagtctaaagaaaagtctaaaaagcagacactaccaccagctcctccttacagacgtagtaatggagccaggtatgaagactcagctcgagaaatttagtatttccaaagcgact

SEQ ID NO: 4882 - DNA, 413 bp, Homo sapiens
  ENST00000596360
acacctctgccttccttccaagcacaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgc

SEQ ID NO: 4883 - DNA, 1792 bp, Homo sapiens
  ENST00000392386
ggggccgggcggggccagcggcgcattagcgccttgtcaattcggctgctcagacttgctccggcctccgcgtccgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgc

SEQ ID NO: 4884 - DNA, 520 bp, Homo sapiens
  ENST00000597131
gccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggaagcgcccgggcccgggcggcggggcgtgcgaaccgcggggcggagagccgagctcggggccggtgcggcgcga

SEQ ID NO: 4885 - DNA, 514 bp, Homo sapiens
  ENST00000593286
actcaccgcgtggcgcaccccacccgcgggccgctgagtggatttttccgtggcggggtgtgaataggtcccggggaaagagcttcttaccgctctcctcctgggaatccctcttactgcggtgcgggacccagttcccgcgcaggcctgggtcccggctcccacaggggactacatctccccgtctgcccacgcaggagctccctcccgaggcccccggggcgcccagagcaacctcaaacccatcccgcgcgcgaaggggacagcgcagccagggcgaaggcgagggactccgtgccttcctgctttttctcctttcttccagcaaagcctggggccgaggctactcgcggagaatcgaaaagagacacagctgtgatcagtccccaggatcccacgcttctcatcggctcctccctgctggccacctgctcagtgcacggagacccaccaggagccaccgccgagggcctctactggaccctcaacgggcgccgcctgccccctgagctct

SEQ ID NO: 4886 - DNA, 2179 bp, Homo sapiens
  ENST00000413387
tacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtga

SEQ ID NO: 4887 - DNA, 2890 bp, Homo sapiens
  ENST00000370597
ctggctgccggctgctgccaccgcaatcccggctcctaaatcagcgcggggaggcgctccctccccacgcccggctctccgggctctcggggccgcgattggccgcgccggcgccccccaccccgggcccccggctccagctgccgcgccattggctgcgggcctccgccagcctttacataagaccgggcgcgctcgagtggagttgtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtga

SEQ ID NO: 4888 - DNA, 474 bp, Homo sapiens
  ENST00000436034
ggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggaaagaaccttgctacttggtctctgcaatctccttggaaaatagaatgctcctgtagccagaacactctttggaaatgatgtaacgccacagaatatgctcacgaccagcctcagtagtgaaggcttgttataaaacatagatctattcttcatggggaaaaaaagtcatcccaggatataataaaattacacttaagaatgcagcaacccttttaaaaacatattcaacaaaaaaaaagcccctgccattttctgatatcatggtaatactcctaataaatcacaaaatatg

SEQ ID NO: 4889 - DNA, 1946 bp, Homo sapiens
  ENST00000309155
atgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaaatcccatcaataaaggaaaaaacaaaacaaaa

SEQ ID NO: 4890 - DNA, 433 bp, Homo sapiens
  ENST00000468549
cagacagacaggtctattggacagcattgctccagagaggagggacctcaaatctgtcttgttcaccatttccctagcacttagaacagtgctcaattcatgcttttattcaatggatgaattagttgatgctgatgcttccgctgagagcctcctgctctcctctgctgctgatgctctctccttctgcccctcagggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaag

SEQ ID NO: 4891 - DNA, 2348 bp, Homo sapiens
  ENST00000370591
ctggctgccggctgctgccaccgcaatcccggctcctaaatcagcgcggggaggcgctccctccccacgcccggctctccgggctctcggggccgcgattggccgcgccggcgccccccaccccgggcccccggctccagctgccgcgccattggctgcgggcctccgccagcctttacataagaccgggcgcgctcgagtggagttgtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaaatcccatcaataaaggaaaaaacaaaacaaaactaacagcctttgtggaaaact

SEQ ID NO: 4892 - DNA, 3267 bp, Homo sapiens
  ENST00000008527
ggggcctgtggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcggctcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggtggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaa

SEQ ID NO: 4893 - DNA, 3834 bp, Homo sapiens
  ENST00000552790
aatactggaggtcacatttcaacatgagctttgtaggggacacaatgtccaaatcatatcacttattctgtctctcccttccttttttggtgctacctgcctatcctaccttccttcttccaaacttccctccccttgccatctttcttcccagccctcctcattgtttttctctctacctttccattttttctagctttttcttcttctctttccattattcctattttcttatggaaagatgctctcttgcttttactttccccttgtgtctcccccactttgtcttttgtaaccactccattttctttatctccttacttccttgaatgccttagtttttcttccttccaactgttcttccacttgtatatctagttttatagcaattagggccatttctacagcacttcaaactaaatacatgttaaactgggcatttctacttctggaagtggctgatttggttgtcctagaccaaacaccaggaaaggaagcttggcttggggatgttggaccacttggctggggcggtggttcagttgcatcttagtctcagagatgaaggagagtcacggctactcaccgccagagcaagacaccctccagccatagttccaattctacgatggcatagcgtagtagccctgtagctgcagggtgtggagcctagtgtttgctttttctctacggtgagcacagttacgtggactccagatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggtggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactagaaaatttttttgtcctttaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggtaagaatgaagcattggagcatactgttctttttccttttcctatcttaaacatacattttttaaatgtgcaggaagaagctccatgggcactggtctcagtggtgggaaacgtcctagtcaggaagaggacacacagagtattggtcctaaagtccagagacagagcactaattaggtaaatattttagagctgtatttcttgctttagaagagtatataattaacataaattaagataatttcaaaaatggagcaaatctctattttcaaaccagaaaatcttgaggcattaatttttaagcaatttttacaaactcagttaatttttggtcaagagacatgcatctgtactggagaaattgttgcaccagttttatattcatctgaaccaatgctctttaaattagagatgtttatgattttgtggtcaagttttttcttagaaaaagacaacttttttatttccttactatgtaactatgagtctaaaacaattaaagtggcctgtttattttagtgacattaatataatctttttatgaactttcccctaaatctttgcctcttaaatgttgataaatttcttttatctgttatgatgcttctaaaatctaaattatttccaatttgggaatagttcaaaattttttaaaatgctggcccttattagaagtatcagaaagccttgcctgcattcaatttaattggatttgggatgtcattttgtgatttaaattaatatgaaaaatatttatacgttggatttgccagtttttaaaaattttctgtttcttcagtttctaacactgtttacattttttattgcttagtttttttatgtcaacctaattagactataagtatcttgaagataaggtcaataaacactcatcacatttttgtcattgaattatttgcaatcaagctttacctagtttttttttcccccttaaatcacagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatg

SEQ ID NO: 4894 - DNA, 621 bp, Homo sapiens
  ENST00000549356
atcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattaggtaaatattttagagctgtatttcttgctttagaagagtatataattaacataaattaagataatttcaaaaatggagcaaatctctattttcaaaccagaaaatcttgaggcattaatttttaagcaatttttacaaactcagttaatttttggtcaagagacatgcatctgtactggagaaattgttgcaccagttttatattcatctgaaccaatgctctttaaattagagatgtttatgattttgtggtcaagttttttcttagaaaaagacaacttttttatttccttactatgt

SEQ ID NO: 4895 - DNA, 471 bp, Homo sapiens
  ENST00000546722
attacttcagaagtgatagaaaagtgcacaactcctctgtctgatgaccatgatgagaaatatggagtcccttcactggaagagctaggttttgatacagatggcttatcctctgcagtgtggccaggtggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtattctctaaaattagagcttattgtttaatactttaaaaaaaaattctgataatacttctttgctttttaaccataggtaaagaagaacagttcccctcccctttccctttatgggcaactgttatggcgtgaatttttctatacagcagc

SEQ ID NO: 4896 - DNA, 830 bp, Homo sapiens
  ENST00000550633
cggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcggctcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgaatttacattgacactgaggttacactctaacttctttttccccaaatgatgatcattttccacaaaatgatggccagttattccaacactacttattggatcatttccaattcagtgag

SEQ ID NO: 4897 - DNA, 1017 bp, Homo sapiens
  ENST00000526180
gggtgccattgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataactgtcttgtgtttgaatattccacacacttttaaataaatatacagataccacag

SEQ ID NO: 4898 - DNA, 464 bp, Homo sapiens
  ENST00000524660
aggcccagccaacattgatctaaacctttgggaaatacccctaaacatatctatgcctcagggtttgaaaaacaatgaagtgttggactgtttcagacttctcagattctcactggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataac

SEQ ID NO: 4899 - DNA, 545 bp, Homo sapiens
  ENST00000533280
gaggcagcagatgccaggcttgcacccatccttgcgactggtcccctgggtgatctgtcttcttctctgtccctatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataa

SEQ ID NO: 4900 - DNA, 915 bp, Homo sapiens
  ENST00000525823
ggagctgagtgggcaagggctttggaaggacaagcaggaccagcagaacattccagattgggtgggtggaaaactggcaaagagacctgagccagaagaagaggcctttgtctcacagacaaaccacaaagccaggcattggagtcagagaggcagcagatgccaggcttgcacccatccttgcgactggtcccctgggtgatctgtcttcttctctgtccctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataa

SEQ ID NO: 4901 - DNA, 1119 bp, Homo sapiens
  ENST00000533475
ggcgcagggagcagggagatgtagacctcattgacctctgtgtccaaatgtcggccaccccgaggtgcttccaggtttaagatgccatcatgggagagagcagctcggactcgccaggggtcgacatcagcaggcaggacataggtgcggcagaactctcgggacacgaagccgtggcggtccaggcgctgggggtgccgggcagacacctccagcaggttatccacagtcctcacagtcacctcgtctgggctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 4902 - DNA, 887 bp, Homo sapiens
  ENST00000527950
aacagggagcactgaatttgctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 4903 - DNA, 848 bp, Homo sapiens
  ENST00000227251
gccattgggtgtggacagaaagctagtgaaacaagaccatgacaagtcactggccggctcagacgtgtttgtgtctctcttttcttagctcaaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagc

SEQ ID NO: 4904 - DNA, 1013 bp, Homo sapiens
  ENST00000531198
aaacggcctgggtggatagaagggggacaaggaggcacacccaggccggcaaagagcaggtatcagcactgcaagcaccaagtgtgtcttgagggggtggggtctttctgcccagatgtgggatcctctcctaaacccaggtcaacccagggcacgaggcagatggctgctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagcta

SEQ ID NO: 4905 - DNA, 353 bp, Homo sapiens
  ENST00000528961
gcaggaccagcagaacattccagattggatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaat

SEQ ID NO: 4906 - DNA, 965 bp, Homo sapiens
  ENST00000527899
agcaagaggggagtcaggaggagtagggaacgggagggaggccacactgtagctaggaggagaaggcagctcggaagaggggaaagagaacggaaaggaaagggaggaggaggaggagaaggaggaggagggggaggaggaggaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaa

SEQ ID NO: 4907 - DNA, 517 bp, Homo sapiens
  ENST00000526167
gggtggaaaactggcaaagagacctgagccagaagaagaggcctttgtctcacagacaaaccacaaagccaggcattggagtcagagaggcagcagatgccaggcttgcacccatccttgcgactggtcccctgggtgatctgtcttcttctctgtccctgtaaataaagtttgggtctgatcaccatgagccttagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaa

SEQ ID NO: 4908 - DNA, 695 bp, Homo sapiens
  ENST00000529647
agaaatgcctggaacttgccctcactgagcctaagctcggaggcccctgccctgctgccctccccagctggggcggcccgaggccggacatagtagccatggtagagtctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccc

SEQ ID NO: 4909 - DNA, 981 bp, Homo sapiens
  ENST00000533971
agcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggtatgtagcttgtttttttgttttctgctcattcattcagtgcatactgtaatagtccaggtagtgctatcagctttggaggctggctacattccagtcccaagccataacagtcgggatcaggggttacaaatcaatgtctagaagactaagttaggatagacatattgctgttgttactattatggccagagatgtggcctttgatttgatcgccttagatgggatgatgggatgctgatgccccatttaagccagtggttctgaatctgggccacattagaatcaccaggggaactttcaaaaaacctaatgctcgggcatactccagaccaattagcatatgtgctgccgaagcgagcactactccagaccaattaaatcagcatttttaagggtgggacccaggcatcagcaatttttaaggtaattctaatctacagtcaaggttgagaaccactgattaggtatagggctgtcagacacctagttgctttgcataattacattaactacaggtaccctaaaagcacttgagttgtgacttctcttttagctgtgcaag

SEQ ID NO: 4910 - DNA, 624 bp, Homo sapiens
  ENST00000528628
ataccttctccgaagcgctgctcacccaggcggctcgggttggcaaattcgtactcggcggtggccgggtgggcatgtggcactgagcggcccgacatggctgcagatgcagcagaagccctggtccgaggtgcagccccaacaggcgcagcgcgacccctccagctgcccggagagccagggctcgataggagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtca

SEQ ID NO: 4911 - DNA, 479 bp, Homo sapiens
  ENST00000533879
aggaggaggaggcaccaaacggcctgggtggatagaagggggacaaggaggcacacccaggccggcaaagagcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcg

SEQ ID NO: 4912 - DNA, 977 bp, Homo sapiens
  ENST00000616970
aggaggaggaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagat

SEQ ID NO: 4913 - DNA, 708 bp, Homo sapiens
  ENST00000392096
gcctcgcagccggtccatttccctcgcgtgccgcgctcacccacccgcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgccc

SEQ ID NO: 4914 - DNA, 566 bp, Homo sapiens
  ENST00000496566
aagtcatgggaggggccaggttcgggggaacctctgagcgatccatttcccagactgccagggagctgatggggtgagctctgggagtgcctgtgggtcctagacagcttcacagcttgtgaggtgcagtgggtgggggaagtgaggcagaggatgtatccgttaaccctttggaagccctgatctttctgtcctgatcttgctgtgcctcagaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 4915 - DNA, 437 bp, Homo sapiens
  ENST00000487181
ggagccaagatgcaatcagtattgatgccctgacatgtctattctgattctgccacccagtacctcttagctgggcactaatctaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 4916 - DNA, 893 bp, Homo sapiens
  ENST00000295728
gccggtccatttccctcgcgtgccgcgctcacccacccggtgaatgccctctgctggggtggggaagggaggggagcgcgggaagactgcgagcccctggcagccgggtccagagctaggccgggtccagcccccgggttcttcatccgctacccaggttgggcaggctgtgtgtggctcgaaacggggctcttgagacgctgagcgcgtggtgccacccttcctgtccgcagcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 4917 - DNA, 493 bp, Homo sapiens
  ENST00000453769
ccctcgcgtgccgcgctcacccacccggttgggcaggctgtgtgtggctcgaaacggggctcttgagacgctgagcgcgtggtgccacccttcctgtccgcagcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatc

SEQ ID NO: 4918 - DNA, 560 bp, Homo sapiens
  ENST00000490678
gcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcggtgagcacagcccacttctcctcccctgcctcctagctccaggccctggcctcaccatggcacctagaaaggctgttcaagccctgcatggggtgtgtgtaaacaaactccgagatgggtggtagtagcattatttctcagaatcagaagggtgtctccaagaaagttgggattgtgggcgtaggcccggagcccagaaatcatcaccacggacagcgctgaggccatcccagtcctgagtgcccagggttcccc

SEQ ID NO: 4919 - DNA, 10729 bp, Homo sapiens
  ENST00000389622
gtcgcgtccgcacttctcctgcccgagagagactgagccgcgctggcagctcgcgtcgagtcggtctgccctagccgcatcccgcggcgcccggtcgggctccgggcaccaggcaacacctaggccgttcccttcagacagccccgggccagcggccccctcgggaaatgtccagcggccgcagaaggggcagcgccccctggcacagcttctcccggttcttcgctccccgaagtccttcccgggacaaggaagaggaagaggaggagaggccggggacgagcccgcctccagctccaggccggtccgctgccagtgttgaaaatgagcccatgagcacaagtcagaaaaaggaaaatgtactttcatcagaagcagtaaagattcgccaaagtgaggacaaaaggaaccatgctgagaagccagtcactcttccagtgcaggaagatcccaaaaaggcatatgatctttccagttccacttcagataccaaaataggagaaagtgacagacagccaaaagaaagcttttttcagtttcttggtaacttattcaatatctcggggaaatcatctctaggtgaagctaagcagtcttctttcaaagatgaccaggataaaactgagaaggatttacaaaatcccagtgaccatcatgaagacgggatcaaaagggagagagagattttcagtggctccctaagaacccagacacatccaacagaagaacaagactctaactcatccgaactctcagatgctttttctttggatacaacacaagacagtgaccaagaaaccactaatttgctaaaacaaatcgatggtaaaccagagaagccttcagtaacatatgcaacatatcgaggcccaagacacattgggaaatatttaaagcaacagacaggcttggcaactgtgaataccttggacagagaaaatgaaagttctgactctagtacaaacagacacattgaccctggaagtgagattgaggctggggtactgccactgttgttatcagctagtacagactcatctatgaaaggaaatctacttgaaggcccattagaagactctgattgtagcaaaacaagtttcaacaaggaaaattctttgacaaataacccagaactgcagaatattgcctcttccaataatcttttaaataaaaatgcttgggggagtattgagagaaataggtcatccccttcttctgtgactaactccagctacgatggagaatctgactcacagcaccatttaagttgtgaaccggtttctcagactaacagaaatttggtatgttcagcattgttaacaggaagtaaccatcgcaaagtcccttgcagcccagattttcagagagtaactacaacagaaaatacgataaaagaaaacagcactgtgatgagtaataggacattggtgcaaagagaggagcttgttgagcctcagggccctgctatttctgatttctcttgtagtaaatctgatgggagtgacactactgagcaggaaagtacaaatttgccaagtccaaataaatcaattaggcatgaacatctgcagttgccagagagtgagtgttctgacaagcaaaccatagatagctcatcaaagcaagctgccactcacaccaatatcattgctcttcagagacatgctgtgacagacacagaatttgtaaatgaaggaaagagattgtctgcccaagactcacagaaaaatgtggctgttagagaaatcaggcgagaaacagaaagtgcctcagctggtgaatccatagcttcaagtcatgtaaaagctccagaagataaaattgagtcattacccaaagatactgaccaatactttgaaaccaaagccaaaaagcttgattttaggtcacatgataaaattcctcatattagaatgaataaaaaagacctggcctctttaaattacatcagtgaatcagcagttgtagcaagcttaggaaatgaaaatgcacctgagttgaaatttgaacttaatagaagtcacatttcagaaactcctcttgactctgagagtcctcaacaagctgaagtatcacctgatgctaaaacatctcttagccttgactgtaaaaaactaaatttcagtatttcacctcctacctttgtttctggagttgggatgctgagcaagttggatattcctgatttaatgaatgagggttctcctgtgcccattgaaactgggaatgtcaacattgttggtatttcctatcagcctaggaagtgtaaagaagaaaatgtgaaaaaccatgttgaggctgcaggcaggaagagtcctcctccttccttttgccttgaatatacatctgcaatttttgaattcaaagaagttctttctaatagtgaaaaatgccaggttcttccaggttctgaagccagtggccctcacttaactgggttggagctattgagctttgactctggaaacctctctaaggattgcagttccattttatctcaagaccctaatagagtagagttagtgtcttcaaacactaaagcaaatatgagcataatagagaagtctgattctctttccttggaagccaaaactgctaacattgtatcaaaagctgaaattgatggtcagaacaatgttcttgtggagtcacattctggaagaggaaaaactatatccttgtccaaggtatctctttcaaaagtggagcccagaaacatttctcaggataaaatgtcttcttttccattgaaaattacccatgttccagaaaagcctattttgtcagaattaacctttctagaagttgaacagggcaaacgttttcaatcaattaatcataatgagataggagagaaatgttcagatgctggccttaaagagaattgccaagctgagctttctcctgctgcctccaaatatgaagataagccagaaccagaggtagatgccttaggctctcctcctgctcttcttaaaagtaatatatcttggattttaccacctattcatgatgaaaaaatcagtaggcaaatggcgcagaattgtgaagctcacacttgtgtgtttcatcaatctttggatatttgtgggactaaaaagatttctggtcactcagaaatggcggaactcagcttaactaatatttcccctaaattccaagaaactggcagcatgaaagtaaattcaccttttctggattctgattccagtttggaaaaaaattcttctgcatctgaggactcaagcttccttaaagtaccttctgtgctgaaattggaaaagaaatcctcatcttacagaaagaaagagaacatccattttttaaatggtggtattgatagtgtgtcatcttcctctagttaccctgaagaagttagcatgatagtaaattcacataagccccaaaataatttggattctatacaagttaccaaagatctcacacatgaaggtacctctgtaactaacctgttgtaccctactacctcttatttggaatttgaaacgtctgtctcaattgggacagaagtaaccccatttcaggaacattttgggatttatactgggaagatatccattgatttcccaactgctgcccaatttgacaatctcgtggaagcagagactggagcagttgctgggcctgcagcgtcagttaacagctcaggccaacagtgttctgaagcctctgctgagcacatagaagccaggagaagagcacatgaccaacttttggacctcaaaagtagtttactcaaaaaggccgatacattgattggtgagatttttaattctgtcagggaagaactaaaattcaaacacacagtgagtacctgccaggagcatatagccatagaaggtataatgaatctgggtaccctgaaagaagacatctctgagaaaaacccatcagaagtgacactaacagaaatacaacagacagagggtttggaagagcaaggcatggaaaacatgtcagaagtcaaagagaagccctgtgtttcaccaacagttggtgagaagaatcttcttgttgatcctaatagtatgaatgtatcttgtttgttagaagataaagctagggaattagtcaatgagattatttatgtagcccaagaaaaattgagaaatgatacttttgaagatactgaggatacttgggattctgaacttcaggctaatacttcaaaaattctgaacagtgatagtgttaagccacatgatgtagttagagagttcttggtttcagaacagccagtaaatcaaagcacacaaattagtgaaaataaagtattaaatgaattcttctccctaagtaacttagctagtggcacagagtcaattaagggaggagaaattgttctctaccaaaaatccctattttctggaaatggatctggactgtctgatagtataaatttgcaggaatcagatacggttttactagctgaagacatgtcacataaacggttagatgatagggtaaaaacacatttatttcgcagtgaggactgtaatgagacaatggaaatagagaatgtggataataacaaaactgagacagaggacagaagaactcttgtattaaatttcaaatggcctccacttgtgaatgatgacatccatgcacctggtacatctaaaagcagtttgtctgatagccttgtatgtatatctgaaaaaaacttgccaggacacagtaaaaacacacctcttgcaatgtcagatgtagggaaagtacacaagaaggataatgaaataaatatagggaaaattgaacttataccttccatgttagaaacagggaaaacaaacaaaaaggatgctgaattgaatattctgaaatatgaggcagtccctcctatgatagaaatgggaagaatacataaaatggatgctgaattgaatgtcacgaaaactgagccaaaagctaatgtttttaaaatgggagaagtataccaaatggatgccgagagctgtattgaaaaaactgagggatcagctgtcattttaggaatggaaaaagcttataagatgaaggatactgaaggggatattggcaaaattgaggtgatacctatgatgccagaagtgaaaaatatccaccaaaaggatgctgaaggggatattgtaaagactgagatgacacctgttacagtagacatggaaaatatttaccaaacgcatgctgaaggggatattggcaagactgggacgatagccttgtcagaagtggaaaatatccaccaaaaaggtggtgaagggattagtgaaaaggctgaagtgatacccgttacattagcaatggaaaatacttaccaaaaggatgctgaaggggatattggaaaggctgaagtgatgcctgtgaggttagaaatggaaaatacttacccaaaggatactgaaagagacggtggcaaaactgaggtgatgccccttgcattagaggtagtaaatacttaccaaaaaaatgccaaaggttttaccgggaacactgaagggtctgtgttgaaaatggaagctacttaccgaaagactgctgaagaggtcattaagaatactgaaatagtaccgtgtgtgttaaaagtgaaggaagcacacgagacagcacctgcccccttagaaatggaaaaagcatgcaagagagatgttaaagagactattggagcaactgtgtccacaccctctgtgatagaaatggaaaaaatatccccagaagatcgtggtgagaatattgggaaacacaaagtgttacccgcagtggtagacattgagaaaatacatggaacaggactagaattgaccactaaacaaggggaggccatgcttcctgcatttgaaagtaaaacaccacaagagtatgctgaagggagtgttgaagaaacaaaggaagagcctacagaaataaaggaaggcttgatagcacatgaaaatagacttcctacatatttcaggggatatgaatcccctacattaagtaaggattatgagggctacccagccccagcaatgccagattttcaacctggggataccacagtaagactagacaaaagaatgtctcttactgcaatatatgacaagaggagagagacagattatagtgacaaaggatataatttagcttttgtttctcaagatgaacaagaaaattcttcctttactatattatacgaagagccccttcaagaggaggacaagtatgcttccgcagaagcaagacaaacacagtctgtcttgtttcatgatacgtccgctgacagcatgcctgttctggcatgtgaaaggtctgagagtagaactgaccttgtccatcactttgaaaaaggtactaaattaggtgagacatttgatagtgatagttcagaaatgttcttatcagtggaggccaaaaggtacaaaatttatcctttagcattgtctcccatttatgaggatgacagctcacaggaggacattctatctagtgaggtttcacctggtcaccatggccccaggaaatcaagagacagtgaaaaccagtcctcttctgttttatcccttctccagtcagtgtcagaacgtttaaagatgaattttgatgaagatgacagagaggcagctgatgaggaagaagaggaggaggaggcagcagtattgcataaaggagatctgagagctggaagtggggagcgtgttaccttccagttgccagatccttccatcacattttaccctgatgaccaggagagcgttggaatttctaagaattcatatgtgatgccaaatgaacctactacctccaatctgcaagttggtctgtggccagaaaagacctcgtttctccagaaatctgaccttacttctaaactacattcttctttaaagagtgcttatcatcagtatctgcagacttcccaaagtcattcctcagaaaaaggagccagatttggtggaatttttcaggaaccagtgtcaaaatatttccgtgttcaagacagcccaggcagattgagcccatttatagagaatgttgacaaacaaactctgagatgtaacccaagacctgggaagatggttatctatgatctccatgaaagtacatataaacaagaagtctactgtaatattcctgatgctacatcatggtcttttccaaatggagttctaataaaagttgtaaggggctgctggattttatatgagaaaccacatttccgaggtcagaaatgtgtgctagaagaaggggaaaaggtgttaaatcgtgactggattcttcagaacagaaggcatccacaaagaaactttatattgggttctctcaaacgtgtcttaaaggactgcagcattccagaaatagagcttttcccacaatctgacccagcctgttgtcctgtctacatacagagagcagtccccaatttggaagaactgaatatctccaaatctgtgtccttcactgtgaagtcaggagtttggcttgcctacccagatattaattttaagggacaagctacagttctggaggaagaccatgggctctttgagatttctacagcagaaatgaaatcattacatccgcttcaaatgggtggactgaaagtggaaatgcccatgaacttaaaggttattatttatgaaaaacctcacttccatggacaggctaaagagtttagtgaacatatagattctgttcctaattttttgaaaaataatggagattttcacagaattggatcaattcgtgtcattggtggagtgtgggttgcctatgaaaaagaacattttaaaggccagcagtttctgcttgaagaaggagactttgaagacagtaatgcttgtggtgcattaagtagccctatcttgtctttccggtacttacaagctaattttatagaatcttctgtcacactatttgaatctgacctagaaagtgggaagtttattgacattacaaatcaggaaatttctgatttggaagaaattggctttggcagtaaaacaagatccattcatgttaaaagtggagtatgggttgcctaccagcaaaagttcttctgtggagaacaatacattttagaaaaagggaaatacaaatgcttttttgactggggaggatcaaataatataatcatgtcgatacggccaatccaactggaaccacttgggataaatgaacctccgcatttgctcaaagcattcagcaaaccagggttccaaggtgaatgtatagattttacagaagaaacttctgatttgacttcactcatgccatgttcttttaaagttcttcgaggttgctggctcctctattaccaagaagacatgtttgttaatcactgtgtgttagaagaaggcctctatgctgaccttacttcctgcggttgcccagcatctaaagtcaaatctctcaagcccattgactatgtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagaatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtcatacttttgcaaacagatgagtaattttttagcaacacctgaaaatatactaaactttcctagataaactttaaggtttctatactgaggcttttataatgaacgcacctcgttaagtatttatacttgtaactaaccccaggcagggacctcagctttgttaggaataaggcacaagaagtattttctgtagctattgtttcctcagtccttcaaactaaaaaagtacaaataaataacctatggccaaacttgcactgttacgtgttaaccaagacatccctttaggtgacaagactctataacagtggttacctgtctccatgttgacacttcatcctagatttaaggagaggcatcaatttttttttttttttgcctcaagagaaatttcaaatatccaaattaaaacacagtagcatttgaaccttgaccttaccatctctttaagtaaacgtggagttgatttctctactaaataacagaaacctcagtttttcactcccattgtaagtaacttttatttaagtaagtaaaatcaggtaggaaatcacctttgacttagcttccagtagtcattaccaccttttactgcacaattcacaagcatgttttcctggtgaattggactgaaaattacattttgacaactttttttccttttatccccaacttttgccagaaagcagaaaaatgctctatttttataaagaaagattaaattctccaatgatattttaaaaaatatcaacctacatgcactttagaatgtaaaataacaatgactattttaaactcgaagacccactattttgagtattttttatagactttaaatactgggtttttttcctccttcaatctcaggcttttctccatcttttaagcagcctctgtaactcccttttgtccataggtgttgcgtgcctctcatctgtggggaagtattatttaataaaatttatgttacaggataactttattttaatgggcatgggcttgtctatacacaaaggtatgtatattttcattataaaaaaccagtttaaaattttttcttattttaattgtttgaaatttttctagagccaaagaagctctttaaagaagttgtttcttccaaagaacaaagccaggttaatgacattcaattctaaatgatacattggaattgtgccttttctaccacactggattaaataaacttgtcaaaata

SEQ ID NO: 4920 - DNA, 578 bp, Homo sapiens
  ENST00000495403
aattgacccattccatggaaaaagatagttagaatcctactttactccaaacacaaaaataagttccagatggattaataacaagctaaatgtgaaaagcaaactttacaacttagaagaaaatataggaatctaccctgatgatactgcagtaggatggatttcttcaaacagaaaaagcacaaatgaataagaaaaaggtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaag

SEQ ID NO: 4921 - DNA, 1252 bp, Homo sapiens
  ENST00000485253
aattgacccattccatggaaaaagatagttagaatcctactttactccaaacacaaaaataagttccagatggattaataacaagctaaatgtgaaaagcaaactttacaacttagaagaaaatataggaatctaccctgatgatactgcagtaggatggatttcttcaaacagaaaaagcacaaatgaataagaaaaaggtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagaatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtgagccaaagaagctctttaaagaagttgtttcttccaaagaacaaagccaggttaatgacattcaattctaaatgatacattggaattgtgccttttctaccacactggattaaataaacttgtc

SEQ ID NO: 4922 - DNA, 1035 bp, Homo sapiens
  ENST00000480748
gcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggagttggcttcagttttgggatgaagcagccctgtggtcttggaaatgccagatggacatgtctggccacaatctactgacacttacttcccctgccggaggcgtgctccctgggtcacgtgatcttattggctgggatgtcatttcaagtctacatttttaaggcattagcataatgaaggacattgtgttgtgacaatagacttttggctggacagtagctaagtttgttgcctgtaaattctttcccatgagggcagggtatgtggaggtgcctgggaatgaatctgcaaccctcggcaggttctcagcctgctggtgtgagttggtggtgatgagcttcggaaattgctgaccttgggttctgcctgtccttcggaatgatgtcatccctgtgctggactgctgtccttagggcctgggccgcagagattgagttcttggtctcttgatttgtcagggtgggtgtggtctggggcatctggatggggccctgagattccagaacttcatcgttgagctttacttcagacatgtctgccaactgttaggagacattgttttagttaatgaagtgtatctcaaagatcatgtagtaaaattgacagatgagg

SEQ ID NO: 4923 - DNA, 1581 bp, Homo sapiens
  ENST00000382812
agagctcgcagctccgccggcgcctggtcccagcgcccgcggcgccgcgtccccggcccaaccatggcgtcctccgcggccggctgcgtggtgatcgttggcagaattaaaactctgtacccattgaacaacagctgctcatttcccccagccccagcccctggcatccacccttctagctttctgtctctatgggtacctcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaa

SEQ ID NO: 4924 - DNA, 1485 bp, Homo sapiens
  ENST00000298248
agagctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaca

SEQ ID NO: 4925 - DNA, 1191 bp, Homo sapiens
  ENST00000574448
aggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggttatctaatttttgcataaaatttgcatagtcttctatcaagaagggtgaagaggttaaccatgcacttccggccgggcaaaatgtcctgtttttcaccttgcttggtgaacttgcttagacataaagtttgtttccgtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttggctgcacccatttcactgaatcttaaatgatgctttcaagacagaaggaagaacagtacacctgagatgaccccaaagcctacatcaggcctgctcaacacagcagatcccagatgcttttgagggcaatgaaacaaatctgagatgtac

SEQ ID NO: 4926 - DNA, 461 bp, Homo sapiens
  ENST00000570401
ctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctgctgcacccatttcactgaatcttaaatgatgctttcaagacagaaggaagaacagtacacctgagatgaccccaaaggtgggccttcttttgagaaaatttcaaatgcaaaattccagatttacagatgaaactgtcagtaagacaattcatgggttttcctagtggctttaagctattaaaacttgcaaaactttg

SEQ ID NO: 4927 - DNA, 1471 bp, Homo sapiens
  ENST00000219599
cttgtctgccactatgtgagatatacctttcaccttctgccgtgattgtgaggcctcctcagccacgtggaactgtaaaaactcctggaagaaaagatcctgcaatttggctttttgtgagatggaaaagattacaccttgccctgcaaacttcccccctttaaaggcgaaggtttgttagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgca

SEQ ID NO: 4928 - DNA, 556 bp, Homo sapiens
  ENST00000572113
ctatttcttaataagtatttcgtcctactgattgggagagcatggcctggggaatgagggggtattttgaatctgagtgtgttcacgagtcctttgttcacctctctcctgtgctttgggcttcttagcagcctttggcactaatcctgggcttaaggtctgttttgctgtctcttagctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggtaagatccattgctccctgggcacaaatccaactagcgcacaaggcaggttcacccattggtggaaagagcaatgagtcaccagactctgcagctgaatcattgtgctccatcattcaggtcaattatttacatggtttagcctagtgctaagcccatgaactctggaac

SEQ ID NO: 4929 - DNA, 874 bp, Homo sapiens
  ENST00000576703
tttcaaatggggagtttccctgcacaagctttcttgtctgccactatgtgagatatacctttcaccttctgccgtgattgtgaggcctcctcagccacgtggaactagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccact

SEQ ID NO: 4930 - DNA, 1507 bp, Homo sapiens
  ENST00000571666
cgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggtgaggcccttctgaccccagtcagggctgccacctggctggcctcacctggatcccagggtttcattaacttcccttccagtttggtctgctccagacctcagccaccccacctccttgtaggggaaggagctcctaaacattttgcaaccctctttaattccattccagaaaaatatgggcattatgggtggtgacatgtgtgttcctggaaggagaagctcagtggattttatttttttgctgggctgtcctctaaagaagtgggattggaagcttcttgcagcctggaaaccttcccaatgtggccaacatgataagactgtgttgcccaccttctggcctcattttacggttataatcagcataaaacaagaagggagctgctggcatgcatgttcagataacagcatgtctatttcctcactgacacaatgatcttggcaggacagctccctgagcaccaactcgaatctctgtgtttatggtatcacaaaagcaaatgccaccccaaaaggatttcggggccagcctcctccctaatatcattcagtgtacaaaggatctctctctttttttttttttttttaatcaaatttatctcttatccaattcaggaattccctgggctggcttcaaaagccaaccctgcacagactttagcttcatgcctgggtcagcgtatgtttgtttcctaggccgagatctttgctgagctgggagaagtgattaagggagtgaaacc

SEQ ID NO: 4931 - DNA, 696 bp, Homo sapiens
  ENST00000572914
tggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcat

SEQ ID NO: 4932 - DNA, 457 bp, Homo sapiens
  ENST00000571358
tttgttagaggcgcgcgctttcgagctccgcgcgccgaccacgggcagcgggtgggccccctggcgtctggagcagcggccagcgcagaggacgcaggcagaaggaggaagggctggccggggctcccgagcactcactgctcaagcctcgccgccgcctccgccgctgcggggtgcgcgtccatctggttggggctcctcatcccaacaccctccccaacggcccgccgcgcagccgcccgcgggcgagtctgtagcctgatcctgcgcggacccgccagaggcacaccaggagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcc

SEQ ID NO: 4933 - DNA, 445 bp, Homo sapiens
  ENST00000574787
cgcgcggaggagccgggagcgccacctcagtccccccaccgccccaccccgcgcatgctcccaagagccccagaccacccttctccggcttccgagatacttcatccgttgcttgtcctggcccaccgctcagtcccccaactctaggacgacagaggttagggataaggggaatgagacacgcgccttggctgcagcattcaaggtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataa

SEQ ID NO: 4934 - DNA, 1400 bp, Homo sapiens
  ENST00000543948
gtaaaaactcctggaagaaaagatcctgcaatttggctttttgtgagatggaaaagattacaccttgccctgcaaacttcccccctttaaaggcgaaggtttgttagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtg

SEQ ID NO: 4935 - DNA, 1191 bp, Homo sapiens; identical to SEQ ID NO: 4925
  ENST00000639469

SEQ ID NO: 4936 - DNA, 461 bp, Homo sapiens; identical to SEQ ID NO: 4926
  ENST00000639312

SEQ ID NO: 4937 - DNA, 1400 bp, Homo sapiens; identical to SEQ ID NO: 4934
  ENST00000639592

SEQ ID NO: 4938 - DNA, 1471 bp, Homo sapiens; identical to SEQ ID NO: 4927
  ENST00000640547

SEQ ID NO: 4939 - DNA, 556 bp, Homo sapiens; identical to SEQ ID NO: 4928
  ENST00000640971

SEQ ID NO: 4940 - DNA, 874 bp, Homo sapiens; identical to SEQ ID NO: 4929
  ENST00000640031

SEQ ID NO: 4941 - DNA, 1507 bp, Homo sapiens; identical to SEQ ID NO: 4930
  ENST00000639726

SEQ ID NO: 4942 - DNA, 696 bp, Homo sapiens; identical to SEQ ID NO: 4931
  ENST00000640994

SEQ ID NO: 4943 - DNA, 457 bp, Homo sapiens; identical to SEQ ID NO: 4932
  ENST00000638658

SEQ ID NO: 4944 - DNA, 445 bp, Homo sapiens; identical to SEQ ID NO: 4933
  ENST00000638961

SEQ ID NO: 4945 - DNA, 1661 bp, Homo sapiens
  ENST00000338573
gagaattggggtggggcgcgccaagaggagcaagcattatagaacgtggggagcatgagaaatacacggaggtggaaacgccggagtggctggcgggtaaaggcagcgggcgcagatgaagcgggctgggcgtcccacgcgcagaaccgtcccggacagaagccgcagggctgcgctggctggaaaaaggaacgcgagtacagcgcgcgtggcgcggggtctgctccaggacggaatcttttgggtggcccgcatgaggggtttgcaggaccccgggcctttgggaagttatctgctaaactccagtagaccctgaggagcagcggctcatgaatcttcttaaacttctgtcatcagcggctgggccagctgaaggtgaccatggcacacgagggagagagaagcccgcgagaggcggagaaatgtggggtcgtccaggagggtcgacaaggcaaagaacctgaagacgacccaaaagggtacctagagttgaacttcctctctttttagaagaatggatttctcggagtctgaaaaatttatggttcttctctggaagaattttattttaaagaggcggcgatgtattgctttagttgtggaaatggtcctcacatttctgtttagtgctgcgcttttggcaacacgctctgttattactataaataagaacggacctttcgattttgctgctcagcctgtcgatgaagtgcctttctacatcacagcttccttaatttctccttctcctttggaattggcttacgtgccttccagaagtactgtggttcagggtattattgaaagagtgaaaatggatttaaaccctcaaatgaaaggttagaaattaacattttctgaaaaaacatacagaattactaaatcgatttagtgaagacatacttacaaccttattaactggttcttaacctcccaagtaaaacatcgttggaatcctcatactaagtataaatattatggactttgttaaacttgaaagttaaatttatataaaatattttgttcatagagcccagaacaaatagtaatatttcaaaatgagatgaccaattattattattattctaagttgttatccagttttgtgatactgttttttctatctggttgtgcttcttgaacctgggtaagtatacctccaggggtgtgtgattttgtgccacaggtcagtggtcagttatttaaaataatgttttatattaaaatgtggtgtgagtaatataggaaggctttagaaaacacttaagctatgtagaattattttaaaagccctcagtctctcacttaccttcatattcccggatcagtttcttacctctttctcttagaggtaaatactgtgagaagtttaggtcggccgggcccagtggctcacgcctgtaatcccagcattttgggaggctgaggtgggcagatcacctgaggtcaggagttcaagaccagcctggccaacatggcaaaaccccatctctactaaaaatataagaattagccagacatggtggtatgcacctatagtcccagctacttgggaggctgaggcatgcgaattgcttgaacccaggaggaggaggaggttgcagtgaggtgaaattgcaccactgcactccagcctgggtgacagaccaagactctgtctc

SEQ ID NO: 4946 - DNA, 559 bp, Homo sapiens
  ENST00000561968
agcattatagaacgtggggagcatgagaaatacacggaggtggaaacgccggagtggctggcgggtaaaggcagcgggcgcagatgaagcgggctgggcgtcccacgcgcagaaccgtcccggacagaagccgcagggctgcgctggctggaaaaaggaacgcgagtacagcgcgcgtggcgcggggtctgctccaggacggaatcttttgggtggcccgcatgaggggtttgcaggaccccgggcctttgggaagttatctgctaaactccagtagaccctgaggagcagcggctcatgaatcttcttaaacttctgtcatcagcggctgggccagctgaaggtgaccatggcacacgagggagagagaagcccgcgagaggcggagaaatgtggggtcgtccaggagggtcgacaaggcaaagaacctgaagacgacccaaaaggagttgaacttcctctctttttagaagaatggatttctcggagtctgaaaaatttatggttcttctctggaagaattttattttaaagaggcggcgatgtattgctttagttg

SEQ ID NO: 4947 - DNA, 2028 bp, Homo sapiens
  ENST00000444326
gctctaagaaaagaaagttttgggcctagagtcaggaaaaagccttttcaagtcaagctgagaactttaaggtggtcttggctacctcattttatgcaaagtaggcagaaaatttaaaagaaaagaaacatatttaagtacaattaagaaaattacagtgtttcagttaaagcagttcagtgctttttagaaaaggagctgaaattaaataagttgaacttcctctctttttagaagaatggatttctcggagtctgaaaaatttatggttcttctctggaagaattttattttaaagaggcggcgatgtattgctttagttgtggaaatggtcctcacatttctgtttagtgctgcgcttttggcaacacgctctgttattactataaataagaacggacctttcgattttgctgctcagcctgtcgatgaagtgcctttctacatcacagcttccttaatttctccttctcctttggaattggcttacgtgccttccagaagtactgtggttcagggtattattgaaagagtgaaaatggatttaaaccctcaaatgaaaggttagaaattaacattttctgaaaaaacatacagaattactaaatcgatttagtgaagacatacttacaaccttattaactggttcttaacctcccaagtaaaacatcgttggaatcctcatactaagtataaatattatggactttgttaaacttgaaagttaaatttatataaaatattttgttcatagagcccagaacaaatagtaatatttcaaaatgagatgaccaattattattattattctaagttgttatccagttttgtgatactgttttttctatctggttgtgcttcttgaacctgggtaagtatacctccaggggtgtgtgattttgtgccacaggtcagtggtcagttatttaaaataatgttttatattaaaatgtggtgtgagtaatataggaaggctttagaaaacacttaagctatgtagaattattttaaaagccctcagtctctcacttaccttcatattcccggatcagtttcttacctctttctcttagaggtaaatactgtgagaagtttaggtcggccgggcccagtggctcacgcctgtaatcccagcattttgggaggctgaggtgggcagatcacctgaggtcaggagttcaagaccagcctggccaacatggcaaaaccccatctctactaaaaatataagaattagccagacatggtggtatgcacctatagtcccagctacttgggaggctgaggcatgcgaattgcttgaacccaggaggaggaggaggttgcagtgaggtgaaattgcaccactgcactccagcctgggtgacagaccaagactctgtctcaaaaaaaaaaaaaaaaaagtttgtgggcatctccctagcacacctctctctacacatgtgcgtgcatgtgcacacacacacacacacacacacacacacacagtcaggcaacttttccatctttttttgtctttcaagagatatgagagtccttgagagtagatgccatctcaaagcattcttttttgttgtttgcttttttttatcaaagcattctttaaaataaagactgaaacaggagaatatgaagttcccagtaatttttaaattctacaacaaaaatatctcaacaaatttaaagtctattatgggttactccaatagtcgctttgggttactcaaaatattttctgatttccactctgatgtcttctttgatgcatggaatttcaaaatttttagaaatgtgttgctgaacttccaaacactgggggcttcttatctttctgttgttgatttctgttttaatttcctttcatcagagagtatactcaattccagttctttgacattttgagaactgtttatgactagtacatggtatattttgataaatgttttctgtgaatttgtaaaaactatgtgtgctataggttttgcttctggtgttctataaatgccacctgggcaaagttggctaagt

SEQ ID NO: 4948 - DNA, 556 bp, Homo sapiens
  ENST00000637983
atggatttctcggagtctgaaaaatttatggttcttctctggaagaattttattttaaagaggcggcgatgtattgctttagttgtggaaatggtcctcacatttctgtttagtgctgcgcttttggcaacacgctctgttattactataaataagaacggacctttcgattttgctgctcagcctgtcgatgaagtgcctttctacatcacagcttccttaatttctccttctcctttggaattggcttacgtgccttccagaagtactgtggttcagggtattattgaaagagtgaaaatggatttaaaccctcaaatgaaaggagtaccagctcatgataggagtcagtaattggatgctctgggcagcctatttcttcacgttcctctctttgtattttattatcatcatttttatgtgcataattttctttgtcaaggaacctgcaccagtcatccaaagcagtgacccaacgcttatctttatctttttgctgttttatgccatcgccacaatatgcttcagctttatggttagcactttcttcagtaga

SEQ ID NO: 4949 - DNA, 3697 bp, Homo sapiens
  ENST00000504875
ggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgcagtca

SEQ ID NO: 4950 - DNA, 3989 bp, Homo sapiens
  ENST00000286301
gaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgcagtca

SEQ ID NO: 4951 - DNA, 886 bp, Homo sapiens
  ENST00000509861
gagatgggatctcactatgttgtccaggctggtctggaactcctggccttatgcaatcctcctgcatcaacctcccaaagtgttgggattacaggaatgagccactgcacctgtccctaaacagacttttaagagatcgttattacagttaccctgaggataccaaaatggcctcatctgtcagaatgagggtgatgagagtacccttctgcaagggttactgtgaggattaaatggtaaagcatgccaaggacttggcataggttttatactaaacttactttgactgggtttggggacctctgctgggtaggtctctctaggggtgtgtgttaatggcccctggaccctagggagctgcccatgggcatcctctgtcctatctcccagatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccc

SEQ ID NO: 4952 - DNA, 723 bp, Homo sapiens
  ENST00000515068
gcagggagcccatgggcccttggacagaggccctttggtgcccagggacttaagggacctgtgtgcgtggcagccacggcccatgctgatgagaaggaggccctcatgtccgagctgaagatcatgagccacctgggccagcacgagaacatcgtcaaccttctgggagcctgtacccatggaggcatctcttgaggactgttggaagtgcaccacctcaggcccatccacccaggcctgctgattcaaaatctgcattgcagagattcccggggtgatttatctgcacatgagttgcagcggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttg

SEQ ID NO: 4953 - DNA, 584 bp, Homo sapiens
  ENST00000515239
agggttggcactgggccccaggggcttctgtccctagagcccatggcctccactgcctgcctgcccacacaaagaccatgtgcaatgtgatcagaagctgagaggaccaggccagagggctgtgggagttcagaggtggacggacttttcaggctgaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacc

SEQ ID NO: 4954 - DNA, 711 bp, Homo sapiens
  ENST00000513609
agggttggcactgggccccaggggcttctgtccctagagcccatggcctccactgcctgcctgcccacacaaagaccatgtgcaatgtgatcagaagctgagaggaccaggccagagggctgtgggagttcagaggtggacggacttttcaggctgaagcccaagtaccaggtccgctggaagatcatcgagagctatgagggcaacagttatactttcatcgaccccacgcagctgccttacaacgagaagtgggagttcccccggaacaacctgcagtttggtgagatggcagctcatcactccacagcttcctatcacagggcctgtgggggttgcagggagcccatgggcccttggacagaggccctttggtgcccagggacttaagggacctgtgtgcgtggcaggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacc

SEQ ID NO: 4955 - DNA, 1388 bp, Homo sapiens
  ENST00000502660
aaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtaggtaagcatcagggtggtggtggacagtcggtagggatcctgcaggagtgtgagcagaagggttttgaggaggaagctgatgtcagggaaggagacctgctgaggatatctctgctggagtttgtttatccaaggcctggctaaggagccactctccaggagctttcccttaccctctcctgggatctctctcccatcttggagctcttacagtgcatggctgcattgggtgcaccttagtgccattttttgtttatttggggattggggtccagtagctccctactggacttcatttgttcattctttcatgcattcctttatggaaacatgaaaagacaatgatcacccagtgattatgggggaagcacaa

SEQ ID NO: 4956 - DNA, 655 bp, Homo sapiens
  ENST00000511344
gaagggcagacagagtgtccaaaagcgtgagagcacgaagtgaggagaaggtggagaagagagaagaggaagaggaagaggaagagaggaagcggagggaactgcggccagggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaag

SEQ ID NO: 4957 - DNA, 921 bp, Homo sapiens
  ENST00000543093
atgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtaggcacaccttcaccctctctctgccccgcctga

SEQ ID NO: 4958 - DNA, 12134 bp, Homo sapiens
  ENST00000335551
agaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaaggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaattccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaaataaattatttacacagggtttatacacactatccattgtatataagcattatttcatattatcaagctaaacattcccccatcagcttagttggagtgttagggaaaagtattcctagatatggcacagattttaaaaggaaatacagtattgaagagatttattttattattgcttcaattagctccatttacgtgttgaattcattgaagaggtccaatgagaaaaaaacagaagcctccttatttcacacgttttcctcctttagtaccatcctcatccaattactgtctctctgatactacttaatagcagggggtttgcagaaatttctgtttgccatgtaaaactgtgaatagtaatttattttagatagtcgatgaacttgtgggttttagctcacaatgcagccttcccttttgcagtgttttttttttgtttttttttttttttgtcttttactgtgccatcgatctttgatattgcattgaaagacaatataccacagtagcaccttgaactcagtgaaaattgttcaggatcaaaataccaagtgttcttttagagggaaggaaaaagtacacacactctcctctcacaatgatatattttatacattcatttgttatttgtttcatgctttatgattccagatggaaaggtaatttcagtgacttttcaagtttaaattccattataggtaaatgataagttatgatgcaaataaaatctataagatccccagggcaaataaaaatcaaaacatgaagtagaagatgtggccgtgaggtagtttatgtaacaaattcaaagtgaaaatcatgtttacttttacttatacttatttgataaaaatatttttgaaacgatagtacttattttattatttgatatttcagttcctattcaattgtggcagattttctctgtttcacattttagattggcgttggtaatagaaatgtcagaatgttcaaattggccttcacgttgtcggagtgaacacattgacacctagctttaagactgatttatctgttggtgtactgaaggtttccatgtaggacttcaaatgtggaaaaggaaaagcagtcaggaaaatggggcattctttggagagtcacgcgttttgattcggacatttccgtagagctcggctcccagtgttgtgttcctcggtcgaaagggtctctgctgtttggggactcactggcctctcctagggactcctttgtcttgtgaaccccacgctgttggattctgtatcattatgctgaattctctgcacagttttccctggccaacctgcccacatccttggagatttgctttgccagtgggaatccttacattgctgtttcacagtagacgggacgaggtcagcgggagtcgtgctcctaacacacacattgaacgaaacagaagatgattgaaagtgtgaggaggctcgtgtgcaagggagaacagggttactatacatattagtgtatatatatacatacatatatatatatatatattgtacatatctaagtttgagtcattcaaactaggtgcaaaatgctgacttcagagtctgaattaacatctctgttcccatatccctgacctgctccctggtcaacgatgctatgaaatcctgaaatgacaggacatacatacatacaagaaaccacatatcaaattagatatgattttcctttgtgtgcaaagtcaaactgtcctagggttgccagtttgaagcatgttatttaaatgaaaaaaaaaatcagtgaaattctcgtgtgagaattctgcctagtttcttcctaaggttgtgtgcagtgttgaacggcgtctccgcaaggtgttggaggatctcattttagggcagtcaggagctgtgcttgctgagttaggtctagaagactcttccctgaaggcaacgggaacacgcgtgagggacgcgaccacacactaacagaggacacgtgcttcagagctgtttaaaactgctgcttgttttacacacacatcttgccttttttcaggctagctgcaataatttttttcttctgtaaaatattttgtaaacaacaacaaaaagctattataaaaagggggtaaaaaaaagaacgctggcattatgatcaggaaaacccattgtcatcgccgaccctccctcccgtcccaccacacgctgctgtcacgacgtaggtgcgaaagacctttttgtacagagatatattttttatgaagaatttgtaaaattattaaatatgctgtaattttttgattaatgtaggtacattgttaaaaaataaatgtttttacaatacagaactgtaattttcccaataatgtaaaatgtaccatctctagctgattttcagttccaatcctattacacatgtattaatattaaagtggcctgttaaaatgaacagtatcttttttttgtcaaaaaaattataaagagggtgtaatatagcctgtgcaatgccaccaatctttaaagcaaatcagagttctaattaaatatttaattttagatttcta

SEQ ID NO: 4959 - DNA, 10938 bp, Homo sapiens
  ENST00000400186
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 4960 - DNA, 10938 bp, Homo sapiens; identical to SEQ ID NO: 4959
  ENST00000602723

SEQ ID NO: 4961 - DNA, 11737 bp, Homo sapiens
  ENST00000635120
gactgcgccgtgcccagcctcggtcccctctctgtgggtaaggatggttgagtccagcctccacggcagcggctccttgtgccactagcagcccttcttctgcgctctccgccttttctctctagactggatctctcctcccccccgcgcccccctccccgcatctcccactcgctggctctctctccagctgcctcctctccaggtctctcctggctgcgcgcgctcctctccccgcttctccccctcccgcagcctcgccgccttggtgccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 4962 - DNA, 11740 bp, Homo sapiens
  ENST00000520002
gactgcgccgtgcccagcctcggtcccctctctgtgggtaaggatggttgagtccagcctccacggcagcggctccttgtgccactagcagcccttcttctgcgctctccgccttttctctctagactggatctctcctcccccccgcgcccccctccccgcatctcccactcgctggctctctctccagctgcctcctctccaggtctctcctggctgcgcgcgctcctctccccgcttctccccctcccgcagcctcgccgccttggtgccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 4963 - DNA, 11740 bp, Homo sapiens; identical to SEQ ID NO: 4962
  ENST00000602557

SEQ ID NO: 4964 - DNA, 590 bp, Homo sapiens
  ENST00000519623
ttttgaattcactttgagctgacggttttgtccaaggtgttggatgaagagcacttgaaaataaactgcggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctg

SEQ ID NO: 4965 - DNA, 764 bp, Homo sapiens
  ENST00000523062
ttattgcaacccaggatttttcagccccagttataaaactctgccctgtgtttcagaccactggtcaaactacgtgacccaatttctgctgtcctcaccctggcttagttaattggaacattgtgctaagtaccaaggtcagagatgagtctctgtggatgctgtaaagccatttgattttacagtcttgcttaaaccatagcttctactttactttttttttcttttcgtcagcaatcactggggaagggaaaccaacacggatgcctcagtcaaggaagaaaagctgccacatcatttcagtactaatatcggctaagcttaatagagcatttttataaattaagaacttaaaacggtattatttttaaaagactaaaaataaatacagacatagtttctaaaaagatttgcaagttgatttaattcatttaagtagtcctacatgtgtcacaccttcacacactcagaaggtcacacacaatttcctggtttgttgcattgactcttctaggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctt

SEQ ID NO: 4966 - DNA, 527 bp, Homo sapiens
  ENST00000520561
attcatgagcacggaaatgcctgcgcgtctctttactccatggctcctgagagtggagggagtgtagcctctctatccctttcagttgctgatgccatggtcagctgtctgtcttcctggtccggcttggaccagtgtctcccaggcagacaggtgaggagctgggaggtacctgctgtgctccacgcagagcttcctctttgatctcagtccagactccactttgaaccccgccttcagggaaaggaaggcaggggggatacgcttcctgccgagacacgcacacttcctgcagtggcagatcacaggcccccgtctctgcggagctcagtgagacgccaccacttggggaaatgcaaacgtgcctttgatgccactgcagcgaggataaagacggtctggaaccccttgtgggtacaacgtaacttctcagaacggcaccatctactcccctggctttcctgatgagtatccgatcctgaaggactgcatttggctcatcacggtgcctccagggcacggagttt

SEQ ID NO: 4967 - DNA, 3989 bp, Homo sapiens
  ENST00000523387
aaattatacagagatctggaagtctcaaaagcaatccttttatcctaaaatggatagctcagcatctagctcacctatctctctgcgtccatgacagactgaggtcctgtgtgctttatcctaatttacactcctgaattatcttcggtgagcctcattttcctcatccttcattgtcagacacctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggaggatctggaaacattggtcctgctttcccatgtcttgacaccccattccaagccagatgtcaaggagaagaaaggactttcaattaaaaaaaaaacaaaaactcgaaacaacatgttttttattgtacgccattaatttcctatcactgagatataaaaataaataatacaaataaatgagaacatgaatttgagctattttattttcttgtagggtatcatatctgacagaggtgacacttaattagatagtttgtcagtgtttgccattttataaaattgataaattgataagatgacacttaactctgatatgtaagtcaaataaacattcctaggttctacttgagatttagaagctaagcttataattaataactcctaagaagatgcataaatcatacagagaattcttgtcattttcaatgatgtctgtgctgtacaccttattcttaaagtttgtcatttatttatgaccatgtaaaggtcagagatgttactatagacgtagctgtcttgaagttaaatgacttattaagaactttggtaaaatcaagccatgcactctatttctaagtcaagaattgaaaaattgataatagcatgaagatatttatcaactaactagatattagcgggaaaatagacattagggggattactgcatggtctcgttgcacttatgatttaaaaacttgatgtgaataatagttatttttttcagatctaaacaaaggattcctttataaaagataaaattctctgtgttattttacttttgttggtattgccttgggcttattgatacttagattttcataatactcataaaaattttgccatgttaaagattttagtgacttccttttcttttaggttttgcaatttggagaagttaagtccctccctccctcccttctttccttccctccctccctctttccttccttccttctttccttcccttccttccttccttccttccttccttccttccttcattcctccctccctccctctcattccttccctccctcctttccttcctttgttctttagtatcttcctctctttcttttctgtgttataaagcatattgctgcattctaatgcataaacttttttgggaaagaaaacttattcaatgccaaaatctcaaagataattttaatgctttaggcatagcaagtaaaaatgtcttttattttcaaagttccactgtttttcttcttccttttgctatgtgtgccaaacaccatttttaaagataatcgaatgtgttaaatctgtttattcttcatcacaatcataaaactgctgaattttatgtgaaatgattttcttagaaaataggctatagtttgttataccaatttttcccctttagaagaacaagcaattaagccacctccaggcacaatgaacatctgaacaattcattctgaattatgtgagcatgcaaactgttgcttgtatacaaaccataatttgtacataaagttgatatgcttct

SEQ ID NO: 4968 - DNA, 3714 bp, Homo sapiens
  ENST00000523488
cactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtaagtgaaaatgttaccaattcctaaaagttcatttttttcatttccatcttggaaagaattaagcagaataaaatgccttattctgttggcataactgtatctgtaattgaaagtggcgtacagatttaaataaagctttggcagagt

SEQ ID NO: 4969 - DNA, 532 bp, Homo sapiens
  ENST00000520451
attaggcgttagagacctactcgatgtttcagggatagatagattaggcgtttagttcgacacacttcatgtttaaaaagcctcttctaggccgggtgcggtggctcatgcctgtaaagccagcactttgggaggctgaggcgggcggatcacgaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttaga

SEQ ID NO: 4970 - DNA, 1003 bp, Homo sapiens
  ENST00000521646
cctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccagatctcaggctggaacacgaagacgctggtctgaccaccccaaagccagtcattcagctactctccacaaaatgtagcttgccacttctgggaaccagtgagaatcgggcaccagtctccatctccctgagaacctgataaacatttgactcctacacctggaataaatcatgtcctggttttctagttttagaaaagaaggttcctataacccctcagtcgtaattaagaaactgacccagttaccctgcttcactgcaggaagaaactgggctgttatgtccctctcactccacccacattcgtcccctcactggcgaatccagccatgaaactaaatcaagctggtgtctttccaaaccaaaggtgggaaactcttcacaaagtgcaaaacagcctgtccatcacacccaagaagccatcactactcttttgtaggtgggaggatgggtgggaagatggaaatctctcatttttttgtctttatgaacctgggaccaaaaaaaaaacgaggaactttacctataaattagattgtgttgtgattcataaaccatgctaattttataatttaaaacattggaattagttatgattttaaaaatttttaaatagaactcaaaaagaaatgttttcctcatatgattgatgttttaagtgtggccattgtttccaagcaaaaatgacatttattcaattgtattaaatgagatttcttagtaggctatttttacttgattctatgtcagtaacatgtgaaataagcattagaggtgtgattaaattattggagagaaaat

SEQ ID NO: 4971 - DNA, 181 bp, Homo sapiens
  ENST00000524177
acatctctagtcacctcacatgaacaactgtgccatattttttccaggactgtcccagttgtaacattgctcacgggatccagtgttcctgacctcattgtgagcatgagcaaccagatgtggctacatctgcagtcggatgatagcattggctcacctgggtttaaagctgtttaccaag

SEQ ID NO: 4972 - DNA, 312 bp, Homo sapiens
  ENST00000520630
cacagtggtgatctgtagctgtgtgagtgcacggaacagcatgccagcatcagctcagatatcattatttacaccacatactccagaaaaagcaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaag

SEQ ID NO: 4973 - DNA, 126 bp, Homo sapiens
  ENST00000519090
aaatggtagaagagcaggttccgacttcagggttggtgcaaatgtacagttttcatgtgaggacaattacgtgctccagggatctaaaagcatcacctgtcagagagttacagagacgctcgctgc

SEQ ID NO: 4974 - DNA, 334 bp, Homo sapiens
  ENST00000518151
tccagtgaaaaaggcgattgagttgaagtcaagaggagtcaagatgctgcccagcaaggatggaagccataaaaactctgtctggcatcagcaagagttcagcaagtgcaggaagaaaaagagagagatcatgacaaggaatgggagaatttccctgacagcctcaggaaacttgcagtttgataattaaacagatcaagctcactcagatgagctgatgggacatgctgtgtacggaggagcatttgcagttacaacactttgtagccatgcaggatggggcaattaatccagaaccattatttaataaaaagatgattttttaaatgtggaa

SEQ ID NO: 4975 - DNA, 13512 bp, Homo sapiens
  ENST00000537824
gttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctgactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaagaagacacctttctgatagaggctcacacctacaaatgcttcactctgtccttccgagacctgacaagctttgaggacctcacagctcccctgtgtgttcatctctagggatgtttgcaatttcccagtcagctgttctgtcgcagaatgtttaatgcacaattttttgcactagtgtgttatgaatgactaagattctgataaaaaaaataaattatttacacagggtttatacacactatccattgtatataagcattatttcatattatcaagctaaacattcccccatcagcttagttggagtgttagggaaaagtattcctagatatggcacagattttaaaaggaaatacagtattgaagagatttattttattattgcttcaattagctccatttacgtgttgaattcattgaagaggtccaatgagaaaaaaacagaagcctccttatttcacacgttttcctcctttagtaccatcctcatccaattactgtctctctgatactacttaatagcagggggtttgcagaaatttctgtttgccatgtaaaactgtgaatagtaatttattttagatagtcgatgaacttgtgggttttagctcacaatgcagccttcccttttgcagtgttttttttttgtttttttttttttttgtcttttactgtgccatcgatctttgatattgcattgaaagacaatataccacagtagcaccttgaactcagtgaaaattgttcaggatcaaaataccaagtgttcttttagagggaaggaaaaagtacacacactctcctctcacaatgatatattttatacattcatttgttatttgtttcatgctttatgattccagatggaaaggtaatttcagtgacttttcaagtttaaattccattataggtaaatgataagttatgatgcaaataaaatctataagatccccagggcaaataaaaatcaaaacatgaagtagaagatgtggccgtgaggtagtttatgtaacaaattcaaagtgaaaatcatgtttacttttacttatacttatttgataaaaatatttttgaaacgatagtacttattttattatttgatatttcagttcctattcaattgtggcagattttctctgtttcacattttagattggcgttggtaatagaaatgtcagaatgttcaaattggccttcacgttgtcggagtgaacacattgacacctagctttaagactgatttatctgttggtgtactgaaggtttccatgtaggacttcaaatgtggaaaaggaaaagcagtcaggaaaatggggcattctttggagagtcacgcgttttgattcggacatttccgtagagctcggctcccagtgttgtgttcctcggtcgaaagggtctctgctgtttggggactcactggcctctcctagggactcctttgtcttgtgaaccccacgctgttggattctgtatcattatgctgaattctctgcacagttttccctggccaacctgcccacatccttggagatttgctttgccagtgggaatccttacattgctgtttcacagtagacgggacgaggtcagcgggagtcgtgctcctaacacacacattgaacgaaacagaagatgattgaaagtgtgaggaggctcgtgtgcaagggagaacagggttactatacatattagtgtatatatatacatacatatatatatatatatattgtacatatctaagtttgagtcattcaaactaggtgcaaaatgctgacttcagagtctgaattaacatctctgttcccatatccctgacctgctccctggtcaacgatgctatgaaatcctgaaatgacaggacatacatacatacaagaaaccacatatcaaattagatatgattttcctttgtgtgcaaagtcaaactgtcctagggttgccagtttgaagcatgttatttaaatgaaaaaaaaaatcagtgaaattctcgtgtgagaattctgcctagtttcttcctaaggttgtgtgcagtgttgaacggcgtctccgcaaggtgttggaggatctcattttagggcagtcaggagctgtgcttgctgagttaggtctagaagactcttccctgaaggcaacgggaacacgcgtgagggacgcgaccacacactaacagaggacacgtgcttcagagctgtttaaaactgctgcttgttttacacacacatcttgccttttttcaggctagctgcaataatttttttcttctgtaaaatattttgtaaacaacaacaaaaagctattataaaaagggggtaaaaaaaagaacgctggcattatgatcaggaaaacccattgtcatcgccgaccctccctcccgtcccaccacacgctgctgtcacgacgtaggtgcgaaagacctttttgtacagagatatattttttatgaagaatttgtaaaattattaaatatgctgtaattttttgattaatgtaggtacattgttaaaaaataaatgtttttacaatacagaactgtaattttcccaataatgtaaaatgtaccatctctagctgattttcagttccaatcctattacacatgtattaatattaaagtggcctgttaaaatgaacagtatcttttttttgtcaaaaaaattataaagagggtgtaatatagcctgtgcaatgccaccaatctttaaagcaaatcagagttctaattaaatatttaattttagatttct

SEQ ID NO: 4976 - DNA, 12134 bp, Homo sapiens; identical to SEQ ID NO: 4958
  ENST00000335551

SEQ ID NO: 4977 - DNA, 10938 bp, Homo sapiens; identical to SEQ ID NO: 4959
  ENST00000400186

SEQ ID NO: 4978 - DNA, 10938 bp, Homo sapiens; identical to SEQ ID NO: 4959
  ENST00000602723

SEQ ID NO: 4979 - DNA, 11737 bp, Homo sapiens; identical to SEQ ID NO: 4961
  ENST00000635120

SEQ ID NO: 4980 - DNA, 11740 bp, Homo sapiens; identical to SEQ ID NO: 4962
  ENST00000520002

SEQ ID NO: 4981 - DNA, 11740 bp, Homo sapiens; identical to SEQ ID NO: 4962
  ENST00000602557

SEQ ID NO: 4982 - DNA, 590 bp, Homo sapiens; identical to SEQ ID NO: 4964
  ENST00000519623

SEQ ID NO: 4983 - DNA, 764 bp, Homo sapiens; identical to SEQ ID NO: 4965
  ENST00000523062

SEQ ID NO: 4984 - DNA, 527 bp, Homo sapiens; identical to SEQ ID NO: 4966
  ENST00000520561

SEQ ID NO: 4985 - DNA, 3989 bp, Homo sapiens; identical to SEQ ID NO: 4967
  ENST00000523387

SEQ ID NO: 4986 - DNA, 3714 bp, Homo sapiens; identical to SEQ ID NO: 4968
  ENST00000523488

SEQ ID NO: 4987 - DNA, 532 bp, Homo sapiens; identical to SEQ ID NO: 4969
  ENST00000520451

SEQ ID NO: 4988 - DNA, 1003 bp, Homo sapiens; identical to SEQ ID NO: 4970
  ENST00000521646

SEQ ID NO: 4989 - DNA, 181 bp, Homo sapiens; identical to SEQ ID NO: 4971
  ENST00000524177

SEQ ID NO: 4990 - DNA, 312 bp, Homo sapiens; identical to SEQ ID NO: 4972
  ENST00000520630

SEQ ID NO: 4991 - DNA, 126 bp, Homo sapiens; identical to SEQ ID NO: 4973
  ENST00000519090

SEQ ID NO: 4992 - DNA, 334 bp, Homo sapiens; identical to SEQ ID NO: 4974
  ENST00000518151

SEQ ID NO: 4993 - DNA, 13512 bp, Homo sapiens; identical to SEQ ID NO: 4975
  ENST00000537824

SEQ ID NO: 4994 - DNA, 13108 bp, Homo sapiens
  ENST00000241312
tcctgggatggggtaggaggctattgtgaatgaggctcataagcatcgcccccggccctagatggcaagttcaaagccaccacccaagatcagctggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggatttgacttactcccaccagatttcttccttcctgagaggttttgatctctcggagttggaaagaaccaactcaactcctcccgtcgccgcttcctatgtctgggatcttgatcctggttgtgaagcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgctggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattg

SEQ ID NO: 4995 - DNA, 749 bp, Homo sapiens
  ENST00000465819
cacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgccaattacctgtggacacccaggcaaccctgtcaacggcctcactcagggtaaccagtttaacctcaacgatgtggtcaagtttgtttgcaaccctgggtatatggctgagggggctgctag

SEQ ID NO: 4996 - DNA, 4379 bp, Homo sapiens
  ENST00000373380
gagagacagacaaacagcacaagagacagaaacaaagcaggcagcaccataggtagggaagtattttttttttaagtttgagaggcatttctgtagacagtccaacaactggacagacacgcaggcaccttggcaggtagacaggcaaacgacttgtcatctttgtcaggttcttcagagctgtgagttgctttctggatgcagctgatgggggttaatctatggttattgtgattctctttccagctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgggcacttggcagctgtttgtacattgtgacacccctccacgcacacatctgccccccagccacagaagcttggaccagaggtggacacctgagctgactgcagcaggggcaatcagatgttctctcttgggaagttgaaataggacccaagagattctacttttgcctggacccatctcctgaaaagataaaaatccaagtgcaatggattgctgctcttctactttccatgtggaccaaaaagtagaacaatcctatgtgcagaaagagaatgattgagaagtggaaaaatttccttggtttctgatggcccttcagttcctcgtcctctacctttgtgaagtctggctgcaaacccacccttgggttctctcttctctgagaggcttttttgcttattctagcctgaattgatttatttacatccaaaggttcccaaggaatacaacaacctaggacccagcaatcctacttctgggaattatgcaaagatatgtgcatgaagatattgcttgatatgttataacagggaaattagaaataatctaaatgtaaaaatagtaagagattaggtattataaatttaaagtgtatactcagagagagagagatagggaaagatacagtcattacaaatcattcatgtatgaacctgggcaacatagtgagactctgcctctacc

SEQ ID NO: 4997 - DNA, 2431 bp, Homo sapiens
  ENST00000489419
ccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccggtcagtatggaagcctggcctggtgggaagggccaggctttcaagtcaaggctgagcttgactcccgtctccaccatttgcggatcatgtgaccttgagtgagttgtataacctcttggagcctcagtgtcttcagagttatgagaattaaatgtattagcctatgtgagagctctcagtgcagggttctgtaaatgcaagttttcctcctattccacactgccagggcagagaggcacagaagcccaaaccttggtgccaagtccactcattcacatcaactcactggctggatcatccctatacctgtgccccagcttatcccttagcactttctagcgggttctccttctccaaagggatctagggcttctgctgacctctcaaggagcactgtgtttttgtgcacaaatgaagatattgtgattttgagtaggaagagtatgaacaattcagagtaggtatgcctttattggcagcctgttttcttctacaagtcccaagttagggatctggatatttcctcatttttattatagtggaattgcctagagaaacttatagaatgttctctgtggacttgtgcctatctatggaatgatgcacatatttgcaatttacagatcactgcagatattttaaccagaaatcaggaaagctggattttactcccagctccaccttgggccagctgtgtaaaaccttgcacaggtcccttccccacttgagacttcagtttcttcacctgtagaattaccggcttggagtttgtgacctgtaagaattctgtgaggtagtaaggcaaatattctaacccccactttacaaatgaagaaatagggcaaaggaaggctcaagtacttgcccaaaaccatgtggatagaactggaaacagaacccagcctccgcagtatctgctgcagtatctgctacagtatctgctctggtgtgactatacagtgttattacatcatgcgtgcacttgcagaaacacactaagactgtgaaagaggtagtgaaagaaacaggaagcaacagagagaaacaaggatgtaaagaacctaagcagctgtgactgccattcccaggagctatcgtccagggtgagtgcaatgtgggaatgagactccgccctctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcacccttctgagcctcaatgttattatgcacaaaataggaatcatataagtacctaacctcctaaagttaaatgaaacaatgcttggaaatccttagctccaggcacagagtataaaaggtgatcaataaattatagttctaatagtcatcattgtcatgattatttttattatatctagatattgacaggcttggtgtaaagttaccttggtggtaggccaggtctcttgttcctgttcctgagccttcacctgtaccagaaccaggcaaaggaggctcagcacagccccaggccatccttatttccaagttcttctcagcaaggtctttcattgagagtgcttgcctaagggcacaatgctccttctgcctctcagatgagacacaaggcccttgctatggtgtaaatgcttaggcccccctagaattcatatgctgacatcctaacccccaaggtgatggtattaggaggtggggccttgggaggcaattaggtcagacaacagagccctcatgaatgggattagtgcctttataaaagagacccacagaatcaccacactgaagccttctcagtggaaagagctaagaagcacaggaaacacagaggccgaggtgggcggatcgcctgaggtgaggagttcaagaccagcctgaccaacatggagaaaccctgtctctactaaaaatacaaaattagatgggcgtggtggcgcatgcctgtaatcccagctactcaggaggctgaggcagaagaatcggttgaacctgggaggcggaggttgcagtgagccaagatcacgccattgcactccagcctgggcaacaagtgtgaaactccatctc

SEQ ID NO: 4998 - DNA, 3212 bp, Homo sapiens
  ENST00000373377
caggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgatcactgcagatattttaaccagaaatcaggaaagctggattttactcccagctccaccttgggccagctgtgtaaaaccttgcacaggtcccttccccacttgagacttcagtttcttcacctgtagaattaccggcttggagtttgtgacctgtaagaattctgtgaggtagtaaggcaaatattctaacccccactttacaaatgaagaaatagggcaaaggaaggctcaagtacttgcccaaaaccatgtggatagaactggaaacagaacccagcctccgcagtatctgctgcagtatctgctacagtatctgctctggtgtgactatacagtgttattacatcatgcgtgcacttgcagaaacacactaagactgtgaaagaggtagtgaaagaaacaggaagcaacagagagaaacaaggatgtaaagaacctaagcagctgtgactgccattcccaggagctatcgtccagggtgagtgcaatgtgggaatgagactccgccctctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcacccttctgagcctcaatgttattatgcacaaaataggaatcatataagtacctaacctcctaaagttaaatgaaacaatgcttggaaatccttagctccaggcacagagtataaaaggtgatcaataaattatagttctaatagtcatcattgtcatgattatttttattatatctagatattgacaggcttggtgtaaagttaccttggtggtaggccaggtctcttgttcctgttcctgagccttcacctgtaccagaaccaggcaaaggaggctcagcacagccccaggccatccttatttccaagttcttctcagcaaggtctttcattgagagtgcttgcctaagggcacaatgctccttctgcctctcagatgagacacaaggcccttgctatggtgtaaatgcttaggcccccctagaattcatatgctgacatcctaacccccaaggtgatggtattaggaggtggggccttgggaggcaattaggtcagacaacagagccctcatgaatgggattagtgcctttataaaagagacccacagaatcaccacactgaagccttctcagtggaaagagctaagaagcacaggaaacacagaggccgaggtgggcggatcgcctgaggtgaggagttcaagaccagcctgaccaacatggagaaaccctgtctctactaaaaatacaaaattagatgggcgtggtggcgcatgcctgtaatcccagctactcaggaggctgaggcagaagaatcggttgaacctgggaggcggaggttgcagtgagccaagatcacgccattgcactccagcctgggcaacaagtgtgaaactccatctc

SEQ ID NO: 4999 - DNA, 1544 bp, Homo sapiens
  ENST00000338325
caactgatgaaaggaggaagaagaaagggacttggaacaagcaagaaaatgagcctaatggtggcccatgtgatcaaatttgcataaggacagaagacaagaccgaaggagctgatgggtagagaggagatattgctgtcaacagagtggaggtctcagtggggaaagatgaactctactggaggttcagaaaacaactgtgaaagaaatacttgaggcatgtttcaacagactgcaaatataccatctaattcttggaaacaagtacaagataaattgattctgaagctgagggctttgggcagcaaaatctgactttccggaagaggtgtaagatggtgctggtggagctttgtaaggattctctgcagggctagagttctgagtccacaggtcctctttgcaaagcccgcatgtgtgatgcccaccttcgaggcccctcgggcatcatcacctcccccaatttccccattcagtatgacaacaatgcacactgtgtgtggatcatcacagcactcaacccctccaaggcgggaggagacccagggaacatacaatgcaacaaggagggtctaagtgtggaaactcaaagtctaagactgaggaatagaagttgtcttctgggaaacagcaaggacaatggatgctgtgtgcctaaccctgttcatggaactggcctacaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgtgtaagtgagcagggaggaggccacgccagggtcttcactgagaggcaggggcccgtttcctagctaatccaggggccccgtccctgggaaccttgcaggttgtaacaacagctgcactctggttggtttattctactcctcggaacgttgctggtggggtccttatttctggcaggaatgtcgactgtagcactgagaacaagtgctcctgacatttggggatgctcttcaacaccgtcttacccttcttggtgatccttaagagcaaggagacaccactgggacaaagcccaccaggctcagacccagacatttcctgctcaccgtcattgccacccctgacaccatctaatccagcagggtggaagggactgtcaagtttgtaaggctgtagacaccaccagcctccagtaactgtgggaaactggccttgccaggatataaacagtttcctaaaattg

SEQ ID NO: 5000 - DNA, 355 bp, Homo sapiens
  ENST00000471438
acgagggctatgacctgcaagggtccaagcggatcacctgtatgaaagtgagcgacatgtttgcggcctggagcgaccacaggccagtctgccgagatttaaacaactgcttttaaaaagttagtggagaagaagaaagctaagaagaaattcggtcagaaacgtaggagaaaagccaaaaagcgtcactgaagccaaagaatcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgat

SEQ ID NO: 5001 - DNA, 13118 bp, Homo sapiens
  ENST00000373388
tcctgggatggggtaggaggctattgtgaatgaggctcataagcatcgcccccggccctagatggcaagttcaaagccaccacccaagatcagctggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggatttgacttactcccaccagatttcttccttcctgagaggttttgatctctcggagttggaaagaaccaactcaactcctcccgtcgccgcttcctatgtctgggatcttgatcctggttgtgaagcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgctggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattggttttcttac

SEQ ID NO: 5002 - DNA, 13698 bp, Homo sapiens
  ENST00000373381
gagagcgcagcgcgcctctccccggccgggcggacacttggttcattccagccgcagaagctcagggctcccgcgtaccgggattttttccgagcagaaaaaagctccagagctctcctgacctcctttctcctcggcggcgagcggagcctctccctcggcgctgccggccgcgccatgccgcgctcgcggggacgggagctggggcgctgcggctgccccgcggggagggctcgcggcgaaaccgggatttcggcgcttgtgccgggcgccgggagccgctggggccgcccgccgccgccaacgccgccgcctctgctgctgttgctgggctgtgggttgctcagcgtctcggccgccgcgggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgccactcagaccaagctccactccattttctataagctcctcttcgatgtactctcttccccatccctcaccaaagctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgccaattacctgtggacacccaggcaaccctgtcaacggcctcactcagggtaaccagtttaacctcaacgatgtggtcaagtttgtttgcaaccctgggtatatggctgagggggctgctaggtcccaatgcctggccagcgggcaatggagtgacatgctgcccacctgcagaatcatcaactgtacagatcctggacaccaagaaaatagtgttcgtcaggtccacgccagcggcccgcacaggttcagcttcggcaccactgtgtcttaccggtgcaaccacggcttctacctcctgggcaccccagtgctcagctgccagggagatggcacatgggaccgtccccgcccccagtgtctcttggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattggttttcttac

SEQ ID NO: 5003 - DNA, 13430 bp, Homo sapiens
  ENST00000619121
tcctgggatggggtaggaggctattgtgaatgaggctcataagcatcgcccccggccctagatggcaagttcaaagccaccacccaagatcagctggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgccactcagaccaagctccactccattttctataagctcctcttcgatgtactctcttccccatccctcaccaaagctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgccaattacctgtggacacccaggcaaccctgtcaacggcctcactcagggtaaccagtttaacctcaacgatgtggtcaagtttgtttgcaaccctgggtatatggctgagggggctgctaggtcccaatgcctggccagcgggcaatggagtgacatgctgcccacctgcagaatcatcaactgtacagatcctggacaccaagaaaatagtgttcgtcaggtccacgccagcggcccgcacaggttcagcttcggcaccactgtgtcttaccggtgcaaccacggcttctacctcctgggcaccccagtgctcagctgccagggagatggcacatgggaccgtccccgcccccagtgtctcttggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattggttttcttac

SEQ ID NO: 5004 - DNA, 8290 bp, Homo sapiens
  ENST00000308508
gcgcccaggagcagagccgcgctcgctccactcagctcccagctcccaggactccgctggctcctcgcaagtcctgccgcccagcccgccgggatgcagtccgggccgcggcccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggacattatgaagctttctccaccctggcccctgaggcttggccagccatggagctgcctgagccatgcgtgcctgagccagggctgcctcctgtctttgccaatttcacccagctgctgactatcagcccactggtggtggccgaggggggcacagcctggcttgagtggaggcatgtgcagcccacgctggacctgatggaggctgagctgcgcaaatcccaggtgctgttcagcgtgacccgaggggcacgccatggcgagctcgagctggacatcccgggagcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccaccgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcagggggcaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagcacgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacagctagtccgggctggtcagccagccacagccttctcccagcaggacctgctggatggggccgttctctatagccacaatggcagcctcagcccccgcgacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggagccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccctaga

SEQ ID NO: 5005 - DNA, 8290 bp, Homo sapiens; identical to SEQ ID NO: 5004
  ENST00000308508

SEQ ID NO: 5006 - DNA, 2089 bp, Homo sapiens
  ENST00000456150
gtgtgatcctcgtcttgggggcagactccgggacggggcttagaggtaccgggtggctggggtcacactggggcggtggggtctgagggtggcgaggtctgggttgaccaggtctaggcgagcgggcctgaccggggcgggccggggctccagggctcctcagcgcgccgccctgacgtcccgccccttgccctcccgcccgcagcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 5007 - DNA, 4161 bp, Homo sapiens
  ENST00000383738
agatacttaaataattaacaaaatatatttaaaatgagtgggagaacttcctccattaaaccctgttgaaaatgtgtgagtggttgtcatgccccagacatcaaggaacccatccatgaggtcttcccacacagactggcctcaggaagggaaggaggaggtaggccgctctgacagccacaacccgagttgaggaaacaagcaaaggaacacagagagtctacatacagtaaaaggtgacaggagttaagctgcacacaagggaagcagagatgggttggaggcagttaagggtgcgttgctgcctctgtggctgaggtgagtgcaaagccctacatggtcccctgtttagagaaggctattgtttcaaacatattttacttggtccccggaggcagcatgaaactatgaaagaaagagccttaccccttttttcaaggctctccagaccacagttctgggatgggtgtgggtggttgccattcgttcatttatgcctgtctgatatggagcctccctctgttaccagccctgtgcactcaagtgccttgcagtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttgggtgagtaacacattaaggggtagacggtcggtttgggggaataaactaagtaactaggttgcggttcctcctgccgactaagcagacctcctggtgcgtggtcttgggttgccctgtgagccctgaagctgtgaatgggccccacagatcactctaaagccaagcatccatgtgtgcccggctggggatctagacccccctggtctacccaggaacctgagttttggtggtctgagacacctgggggacgacgtatcccggagaagggaccaggattaaaggccgctccccaggctgcccggagactagaaggaaggcgaggtagccgcagtcccagggagggtcttaccccttgctcccgggatgcgttatggcgggcctggctgtgcgagatctaggctagtggctttggctgcgaacggattagatctgatccgattagagcctgggcggtcggcttcgcccccttgccaggctctgccaacgcccgcccctccctcgtggagacccggagacctccctgagagccttcccgcccggaacacgggattggtgcagaatccgagaggctccatgcgccccgggcctggcttgtttccacagtgggggctcgtgcttccgccccctgcggctcttctggaccccgccccgaccctgcgggtaactgggcccgcgacgtccccgcctccgtgcttgccgcgtggcgggtgggttcctccgggtcggggccccgtgccgcctgttcacctggggcgggaccgtggccccatcccacaggtctcccgcccgtgcacctgccgcctaacgccgcgcgccgcgccgtgcgcctgcctcgcgctccccgtccgcctgccccgcactccccgtccgtgtgtctcctagtccccagcgaggggtctgtctgttcccctggcaggctgaccaaggggccggcgtcaccgctacgtgcggcggggccggcgcggcgggcggggtgagggcggcgctgagcgcagcggcggcagcggcggcgcgggaggcggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgtaaggaaactttgcaacactccccgtacctcctccccccatgcccgtgccttggctcactatgataacgttatctgtcaggatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 5008 - DNA, 4080 bp, Homo sapiens
  ENST00000264723
agatacttaaataattaacaaaatatatttaaaatgagtgggagaacttcctccattaaaccctgttgaaaatgtgtgagtggttgtcatgccccagacatcaaggaacccatccatgaggtcttcccacacagactggcctcaggaagggaaggaggaggtaggccgctctgacagccacaacccgagttgaggaaacaagcaaaggaacacagagagtctacatacagtaaaaggtgacaggagttaagctgcacacaagggaagcagagatgggttggaggcagttaagggtgcgttgctgcctctgtggctgaggtgagtgcaaagccctacatggtcccctgtttagagaaggctattgtttcaaacatattttacttggtccccggaggcagcatgaaactatgaaagaaagagccttaccccttttttcaaggctctccagaccacagttctgggatgggtgtgggtggttgccattcgttcatttatgcctgtctgatatggagcctccctctgttaccagccctgtgcactcaagtgccttgcagtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttgggtgagtaacacattaaggggtagacggtcggtttgggggaataaactaagtaactaggttgcggttcctcctgccgactaagcagacctcctggtgcgtggtcttgggttgccctgtgagccctgaagctgtgaatgggccccacagatcactctaaagccaagcatccatgtgtgcccggctggggatctagacccccctggtctacccaggaacctgagttttggtggtctgagacacctgggggacgacgtatcccggagaagggaccaggattaaaggccgctccccaggctgcccggagactagaaggaaggcgaggtagccgcagtcccagggagggtcttaccccttgctcccgggatgcgttatggcgggcctggctgtgcgagatctaggctagtggctttggctgcgaacggattagatctgatccgattagagcctgggcggtcggcttcgcccccttgccaggctctgccaacgcccgcccctccctcgtggagacccggagacctccctgagagccttcccgcccggaacacgggattggtgcagaatccgagaggctccatgcgccccgggcctggcttgtttccacagtgggggctcgtgcttccgccccctgcggctcttctggaccccgccccgaccctgcgggtaactgggcccgcgacgtccccgcctccgtgcttgccgcgtggcgggtgggttcctccgggtcggggccccgtgccgcctgttcacctggggcgggaccgtggccccatcccacaggtctcccgcccgtgcacctgccgcctaacgccgcgcgccgcgccgtgcgcctgcctcgcgctccccgtccgcctgccccgcactccccgtccgtgtgtctcctagtccccagcgaggggtctgtctgttcccctggcaggctgaccaaggggccggcgtcaccgctacgtgcggcggggccggcgcggcgggcggggtgagggcggcgctgagcgcagcggcggcagcggcggcgcgggaggcggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaacaaattccggaccccatctgagctccacaatgataacttctccctctccaccattgccgagggctctcacccaaatgatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaactttttaaaaagtt

SEQ ID NO: 5009 - DNA, 593 bp, Homo sapiens
  ENST00000465441
agtccagtgaggaataactgtagataagatgagatgatgggcattaagtgtaactgctgagaagccttcatagagggaaaggtgataagaactgagtttttctggcatgaggagtttaccaggcaggagaggtggagacgctaggctaggcaaataggctgcagccatagttctgctgagaaacaggttttgaaccaaggcaactccatctggagatatgtatcagaaagattaggagatagaatctccatcttggtcacttatttggtcttctaagacagcaatgggaccgtctcttaaatactggagttgtcctatctccttgggctgataccctgaactgtcatttggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgca

SEQ ID NO: 5010 - DNA, 2073 bp, Homo sapiens
  ENST00000610462
ggggaggcgcggcgcgccggggacagcggcggacggcggcggcggcggcatgcggctcctcgcgctgcccatcgtgggctgaggcggccgcagaaccggcgggaggcgcggcggccgggcgagccgagggcgcagccagccgggcggaccgcggacagcggtcggggcgccgcgccatggggcgagccgggggcgggggcccgggccgggggccgccgccactgctgctgtttctgggggccgcgctggtcctggcctctggggccgtgccggcgcgtgaggcgggcagcgcggttgaggccgaagagctggtgaagggcagcccggcgtgggagccgcctgccaacgacacgcgggaagaagccggcccaccagcggctggggaagatgaggcgtcgtggacggcgcccggtggcgagctggccgggccagaagaggtgctgcaggagtcggctgcggtgaccggcaccgcctggctggaagctgacagcccaggcctgggaggagtgaccgcagaggcgggcagcggcgatgcccaggcccttccagctacgctccaggctccccacgaggtcctcgggcagtcaatcatgccccctgccattcctgaggctacagaggccagcgggccaccctcccccacccccggcgacaagctgagcccagcttctgaactccccaaggagagccccttggaggtttggctgaacctggggggcagcacacccgaccctcaagggccagagctgacttacccatttcagggcaccctggagccccaaccggcatcagatatcattgacatcgactacttcgaaggactggatggtgagggtcgtggcgcagatctggggagcttcccagggtcaccaggaacctcagagaaccaccctgatactgagggagagaccccttcctggagcctgcttgacttatacgatgatttcacccccttcgatgaatctgatttctaccccaccacatccttttatgatgacttggatgaagaggaggaggaagaggaggatgacaaagatgcagtaggaggtggagacctagaagatgaaaatgagcttctagtgcccactgggaagcctggtctggggcccgggacaggccagcccaccagtcggtggcatgctgtccctccacagcacactctggggtcggtccccggcagcagcatcgccctcaggccccgcccaggagagccaggcagggacttggcctccagtgaaaatggcactgagtgccgcagtggctttgtgcggcataacggctcctgccggtcagtgtgcgacctcttcccaagttactgtcacaatggcggccagtgctacctggtggagaacataggggccttctgcaggtgcaacacgcaggactacatctggcacaaggggatgcgctgcgagtccatcatcaccgacttccaggtgatgtgcgtggccgtgggctcggctgccctcgtcctgctcctgctcttcatgatgacggtgttctttgccaagaagctctacctgctcaagacggagaataccaagctgcgtaggaccaagatgatcctagtgctccccacaaaatccaggaggttctcaagtcctgcctgaaagaggaggagtcatttaacatccagaactccatgtcgcccaaacttgagggtggcaaaggtgaccaggctgacttggatgtgaactgtcttcagaataatttaacctaaagcagagcaagaagagaggaagcgggggtagtgggtggggggtaggggaagaaacattatctcctcttgtacagagtctatttcttgtaaccatttgttaaactcttttctttttctgatctcatggcatgcttttatgtattttgtacaggaggcaaaaaaatacttaaaataagcaaagaaactgaacagaattgcatacattgggttgttttttctgtgctgtctgtacattgcttctgctgctgtgatttctaaacctgtgctgttattcaactgacttttttttgtactttgacccacgtttttttgaaataccagtaaaaaacaaagttcttgaaataaaacttttt

SEQ ID NO: 5011 - DNA, 3148 bp, Homo sapiens
  ENST00000273153
cgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttctacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcgtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactggggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgtgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttta

SEQ ID NO: 5012 - DNA, 2593 bp, Homo sapiens
  ENST00000514182
gggcaggagagcattccagtcgagaagaccggctgcagtaaaagcgtgagggtggaaacgctcgaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttctacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcgtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactggggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgtgggcaggtgctggccaaggacatcatctaggcagggggagagcctgggctgaacagctgtgaccaa

SEQ ID NO: 5013 - DNA, 1688 bp, Homo sapiens
  ENST00000421875
attggttggctgccgcctgatggatagacgagggaggagtgtactctcttcagtgtgttctgacggagccgaagtacagaaaccatatttacaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccagaaaaaatgaggaaatatcaacagactgaaaatatgttttcagaggcatagaatcttcaggaaaatactggagttcctgagatctcaaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattacc

SEQ ID NO: 5014 - DNA, 482 bp, Homo sapiens
  ENST00000409664
agtgtgttctgacggagccgaagtacagaaaccatatttacaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaa

SEQ ID NO: 5015 - DNA, 499 bp, Homo sapiens
  ENST00000464503
ctgacggagccgaagtacagaaaccatatttacaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccagaaaaaatgaggaaatatcaacagactgaaaatatgttttcagaggcatagaatcttcaggaaaatactggagttcctgagatctcaagatggagagccacttagcttgcagactgccatctccctaacgtatcagaacaatgaacttggttccaagagtatagaactcagtgaatgtaaaatggatgaatgtatgaattaatgcataaatcaataaatgaacccagatgaataatatgccaaagttgtttctgtatatctctgtgatacaaataaacatatgctcattctatt

SEQ ID NO: 5016 - DNA, 11684 bp, Homo sapiens
  ENST00000342316
ctcagtgaggctgatgccgtgcagcaagcagtaggtaatgagtctttgtgcagagtgaagctcttgttgctgaacaataaagcatatggtacaagcaataaaacacagggctgggaaatttaagaagattcctctgaaccaggaagaactgtgtcttcggtgatgctgacacatatgataaaatgatcatttattttggatcctaatgaataaagagtgcaaggactaagactacagttatttgaacaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagccgcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacagttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgcactttagtgccccttcacggtacctcgtgtggggtggggactgagaactctttgagatgaaaaaatttaaaaaaaaattaaaaagatctttaactattataaggttcatataattaatatagaggaatcatccaatgatacttatgaagggaaaatgacctattttccttcaccactctgaggacctaactcagtaaatgcagaggaggctgaggaaacatggaagagacacgacctcagcaaccagccttttctccagcgtgatcaatccatctctacaaaatcagtgtataatgagatttccacttagtgactagctgattgaaggggggcctctacccaaatactcaactaggcctttcttttctgaagcattttgatttgtcttgcctgggacaactagcagaacagtccagaatgcattgcatactttctaattacctcacattctcttattaaagagaacagatagaaataaaacatgcactccccacctttagattacctgcacttggttcgtcggaggacttctaggatcccgtttccctgtaaattaatttaggtaactaaatagtgtaattctgcctttttttttccaatgcaatatgactatgctaaacctgtttcatatttttgaccttctattgttatatcacttcacatgttttataactatttgaaatgcggacatgacttgctattcagtgactgcatcgctacttattttttatgtcttttagacttgggtgtttagaattatggatataaatatattgtagatctcaatttctaaaaaaaatattttatttaattgaacttaaaaatgcttgatctagagaaagtcctccagtggaaaagtttctactaaactttgttttggggaaaaaatgtttacttggcagctcttccactgtgcagttggtttctgccccttctcttcccccctacattgggccaaatttataactcttaatattaacattaaaagagctttgggtttgtctttatgtaggttgcagtaatgagagcagggttgttccttttgaatgattggccctttgggctaatcagaatgaggatttgttgaaatctcaaatatacatatatatatatatatatatatatatatatatatacacacacacacacacatacacatatatatacacatatatgtatgtgtgtgtgtgtgtgtgtgtgtgtgtatatatatatatcccatgttgtctgcaaagtgacagtttttagtgcttaatctccaaaattttccccctactgatacaatctaaagagcacaggcccaaagagaaaatgacaagaggctattgttccttcattcaagcacatgaaaggatcatgtgtactgtatttgctggaccattacaagctcttgaaggatctgcttgtgaagtactctgaggttattcttggaacacagagtgtgggagagtggggaagagccagctccagcctgagcaaagctgaagggtagaatgacagtccagtttctgaaaagagatattttaattttagttcagctttattttcctaagacgatatgaagcctacttttttatttttggctaggtctttgttttctagctttgtttccaaaaggatgcttaagaaaacagagtttttttcccctatccatttatctagggtagaaagtcactgccctgtgagaagaattacccttccaatcatgacagcttctattccaacttttcatatacctgactaacctgtaaacatatcccacaaaccacatacacaggctacctattaaaactctcccatatacctaacacatacacatgcacacacatacaaaatatatacatatcacacacttagagaatgacagatttcaggcaatggccaatagtcagtattgagtttttctaaccccagaatctggttgggctttatgatctaaaaaaatgtggtttagaaaagaggataattggtagagctgtagtttgaaaatatcaggtcaaagttgcaaacatacttatgatggaatcatttcatttttagttcctttcccagaaaagctgagagagcacactgttccagctgacttttttttccattaatagccgttctattcaacaaagagctgcccacatgccaggaaagtgctacagtccttctaagcttttaaaaatggggatcaagctacatgcagccagttggaatacttaagatctttatgccaagacacaataacctgacctgcagctgttgtattgcctccatagtatatctagccaaactgtagtctttgacacacaactttttagtcattcactatcaattgcaaagcttcatgctccagccctggctattctagtaccagtcctatacctttaaatgggacttaattcccagttataatcctggccgaattgatttgaaagtcaagtggctgaagcagcttgcatctcctttgtcattcccaatttcctttgggagaagtcaatgaaagagatttacttaagtttttcctccttatctcttgatcattaattattaagacatgggtaaaattcatttgtctcatgtcttttggttgattgaataatatagttactttttgaaagcccatcatttctttgtgataaaaccattttctcaatgtgacagccacatgtaaaatgtgaaactaatgtttcttagtatgtttaaaatcttcacaatcatatatggccctgcaatactccctgaattccttccctccaaaaaaaaactatgagttgcaaaaacactagttacgaattaatcaagaagcaaagagagtatgttaagtggctatgttctttaaaattttacattctaatagatgacttctaggcaaaattttggtatgattaccattaaacaggaaaacataccatgatttactttctataacttgctaatcactgtttcttttatttcaatttttgatattgttgcacaagtttatgactctttggtctttatattcaaaatttattaagtatcaattctttctttcaacaaatatgtactgaacacatgctgtgttagaacaactgtcttgggtagtaaaaagaggggaacactacaaattataatggataatattaatgaagggtggcatgaaataatcaagctttctcaaatcctcttaatatgtgattttatcaagtgacattagaaaaactgacatcagttcttgtctaattatatgtgagctgcaactaaaagatgcttcctttacctaaattatagaactcactggatcgcccttcatctctctccctccatctgaaatgtatgaattaaatcaggactcagctaggactgaatcaaatgaaaaagaaattttcgattaattgcttcttcaatgttagacctatataagtgatgctaaatttacaccagcaaactcctatcagacagtttcaaggaggatttgactcatgcataacccaggaaacatttcaggaaacttttaagacaacagtgtggaacacaatcactcttacttctatttataaaaagcctatcaaaacagcaaaatcctgttgcaaattccaaagacatcactttgcagcaggtggaaaacagagaggttgttagactccatcactttcagctggagttacaaaccatcaaattagcaggtggaaaatttatattctcagaagccaacaggagactgcctttttaaaaggtgtcatgaagccttctatttctccaaacaactcaatatttctctttaaaatggcatctctgttccttattctcttgatgacagtttgcagtgccattatagccagtgtattaaataccaggctttaatgggaagcacctttgtgctttcaaaggcaagacttgtctgtaattttaaattagaactgttggttgtattcttaccacaaccaaaacccaaagtttaaaggcttgattactctatattaggtctaatatgaattttcaccttctgattgcattactttttctgaaatctgctaactagtgctggaataacaaaaatgcctaagccaaaatgctgtagctctgcaccaacagcacagctcatcagatgttttctatagtagtaaagaatttgattgacttaattgaatatcagcaattttaatacccactagaattatggaagtatcagagtggaagtgaggacgcaataaaagcttaataagtggtggtgtcttctaggaattatgaaaaaaaaagctcagcagagctaagccagatcttattacatcataaagactagagttacaaatggcagccccaaacctagaaggggcagttacaatgtggacaccctttcagcccagttggtgctcacatctgctgaccaacattcatatcaattacatttttacagtctgtaagtcatttgatgctttagaaaataaaaacacacacctacagcattctaaagaaactattttgttaaaaaatttaaacacattttatattaaaataagtgatcaatgactttcatgattgtcaaaagtaaaaagtgcagacatttaaaaaagctcttctttcacattttacctaccaaatctagatattcaacgtgagtccttaaaacagtcacttctaaattttattttgactcctttcttggctttttcaaactggaccatgagacccccttcctaaacaatgcagttgttttgttttattctttttttccagaaattcaagctgaaacatttgatatgacctgtgttttacctggtgatcagttctcaggctagtctaagtctgtgctgtcttggcatgccttgggtttcctatcctgagagtggtaatgccagtagaatgatgggaaccaggagagtgaatacgaccagattcaaagcctaaaacaatatgtttcagtttacttttatatgtagattttttaaatattcacatctagcctggaattttagtaaatacagatacttgttgtatccatgggaaatgaggtcatttcaaagatgtaagtcacgttggtgactactttcttttacttgtgataaatatatcactatacagggtaattgcttttataaatttgatcctttgcattggcttataattcaagaaatgtcaacttcactgtgtcactttatgtcatctctcataaaagtttctggcaggactaaagtttcaaaggaatgtgatagaatttattttggataacatttgtattcagcatgctaatgatgtaactcctctctttatcattaccacggtgatagttaagttcattcgttaactcattttagtgacatgtgaggccatttaaatatttttaagataatgtatattgattagaaagggttagaaggagacaaatttatggtagaaattagccttgccattgtctaagttaatttatgtgacctgattgaacagttttagttgtaactttagagtagcttctttgttagaggatctctttcctttctcttttggttttctcccaatatttttatctgtcttgggattatcttaaaaggtatttattaatgagtatttggaagaaaattgacctagaaaatgtctcttttaaatttatctaggtacttgtatcaccagagaccttcatcaagtcctactgccacactggataaggccactacccccgacccttcttgtcagggacatggcttcctaataatggttttgctgttgtctctacataggggacctatggaaaaggagtttgaaatttctacctttgtagtacattgtatccaattttgttttgctcctccttttcatgtggtcaccaagcttttttccttagccattaaaaaagccacccctctttaaaacaaatttaaagatctatatacatttttgcaactttatttaataaaaaagagaagaaaaaataaaatctaaatctcaattaccctaaagtggaaaaacctaagtatctaacctaggaacttgttgcctggtggtggttgttgttgttgttgttttttaatttatttagtgttgatccttgagttatttaatggtatccaaatgatatctgaaagtgattgattttaagatgtaatagttggcaaagtcatttcatttgtgtctcaaacaaataaagcccactgccatgggttaccatctgaaccctgattcattaggcactagtcatgccaaatggggatctcagaatagtttaatcttttcaaagatactcacaatggccaactgtgtgtgaatactggaaagtttgagattcttctatattcttcaaatttatggtcctgagactaggagggatctccagaggtcatatggctcatcgatctaccaccagggaagactgtcacttaggcatgcccaacaggagagatcgccatctattcttaacatctctagggaaggcagtttccttggcaacacaattcagctctcttaggttttctcacaataagaaaatatcttggccagtctttgagggttaggcacctggcaacagttgtggtgatttgggccattgtactaggggattcaagggaagttgggtttccccctacatttggtgattattacattaatatatgatcattccataagtctcctaagaaatcagatttttaaagaaagacacggattcagagacaatggtctgtaacatgaccaacttttgacaaatatggctgtactaggttttcatttttgctgttgttgttgtttgtttttgtgattgctcttatgtcggtaggtaatgtcaggaaaagtgactgtttcagatccccagtacaaacatcagaactaggatcaaatgacttgacttttaagctgttccattttctaagaagttacaattacaaaaagtaagcattttctacattcttacttctaagtaatgaccttctcattaatctttccttggcttaaaatgacaaataagaatccaaagtttttccactcctcctgtgggagataggaatagttgtgaagagtctgatggaataaaatgactccagagatttacacagccaccatttgatcccagcctttgtccttgtgttatttaaacaatggcttcctgctttctcaggggtcaggaaaatgatttaaaaatttgtcttcttgacaaggcctgaaaacgaagggaggtgtcgtggagaaatggtgatttttctggttacatcacttgattcaagcactccctggagctttcaaagccttttttatctgctcagagttgacacccaactcagagtcagaactcaccagaagatgaggaacacccccgaaatcaatgtttcctttctccatgggatttttttcaatcttggtacagctgcatatctcccaaactcggatgctcttgtgaaatgacagccacatcagtgtggttactccccacaaataacactagggggaaatgaccttttttatttaaaaaaaaaaaaaaggctaatgctatagaatgatcatgtaaagaatgttgaataaaatttggcccatgttttaattgactctaggcacctctattgaaataagtctgaggcatagtttgtgaaacatgtttcaaaagtgtttgatgtataataaatgctagaaatttacagtacagaaatagtaaaaaaataaaataaaaataaacctgtagattacagctctgttcctaagaacctcagcctttattgtgtcttagtaaagttgatctgctttatttttagtttattgaatttctggtgtactagcctcttaagatagaacttttaatacatatgtactggttaatgcctgtttacgcagaaaatggcactttgttctttcagtgtgtttccctcagtgtcacagggtatatcaatttgatagatcatttgacatttgtcaaaaatacgtttcccattttaaaaatatgtataattggttgcatagacatatgtcactttttgcagtgtcttcatcttgatcatagttttagacatcaactatgtctcactttccaactgccatagaaatttggtacatttgcaaattctggtggaatctagtgagctgaatgtattggtagatcaaatgatccaaaggacttgggtgttatccttcagtctgtgttgaaccattcagatattgggaatggtccttacacaagggaagtcttttgagaatatttgttctcttattttttgtttgtttgttgctggcaaaaaaaaaagtaactttaaaaactcagaaaagccactgaactgtattttgtgaccttatgattagttttatctttcaactgatttttattgttacttttactcaatatcaacagtacttcaatagatatttattagttatgttcaatctaatgacttaaaacagttgaaaaggaggaaaatcaactccagtccacacatacagtcatgttacattaagatgtcatgttgtatgtcacacagtttctagattgatttctcttgtgtataagttataacatcaaaaatgccaaagggtatataaaataagctacaataatattcaacagaacttaacctggaccttatgttgtaataatttattcatattagctgtagtcttctgtatttatattttcagtatttattatgaatgacatggaaattcgtgtatttattgtggctttttattgcagtgtgtatatatatataacaaataagcatttttaagtcttatccttaagtttcttttattagtggcacttgtattatgctgtactttttattacatattgtacaatatcttgtccatttgtttgcagcagagtaaaaccggtttctaagttgta

SEQ ID NO: 5017 - DNA, 2545 bp, Homo sapiens
  ENST00000409420
tcctgctctcccgtgattcaggtagcctggcagaaccgcagttccacaattccttacccagcattccgtttcagctgctggaggactgcctgagccttatgcaaatgagaccagctcggaggctttgactgcagaagcgagaggagggggcagaagggagttcaaaggtcacagggctggtggaaagctggatcagttgcctgaaaaaaatgtactggggttctctgcagcagtgttttgcagcagttaaatgaagtgtgctttatttctgagagtgaagattttacagcgtgtgtgccgtagtcgttatatagtgcacgcaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaa

SEQ ID NO: 5018 - DNA, 11788 bp, Homo sapiens
  ENST00000314499
attggttggctgccgcctgatggatagacgagggaggagtgtactctcttcagtgtgttctgacggagccgaagtacagaaaccatatttacaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccagaaaaaatgaggaaatatcaacagactgaaaatatgttttcagaggcatagaatcttcaggaaaatactggagttcctgagatctcaaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagccgcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacagttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgcactttagtgccccttcacggtacctcgtgtggggtggggactgagaactctttgagatgaaaaaatttaaaaaaaaattaaaaagatctttaactattataaggttcatataattaatatagaggaatcatccaatgatacttatgaagggaaaatgacctattttccttcaccactctgaggacctaactcagtaaatgcagaggaggctgaggaaacatggaagagacacgacctcagcaaccagccttttctccagcgtgatcaatccatctctacaaaatcagtgtataatgagatttccacttagtgactagctgattgaaggggggcctctacccaaatactcaactaggcctttcttttctgaagcattttgatttgtcttgcctgggacaactagcagaacagtccagaatgcattgcatactttctaattacctcacattctcttattaaagagaacagatagaaataaaacatgcactccccacctttagattacctgcacttggttcgtcggaggacttctaggatcccgtttccctgtaaattaatttaggtaactaaatagtgtaattctgcctttttttttccaatgcaatatgactatgctaaacctgtttcatatttttgaccttctattgttatatcacttcacatgttttataactatttgaaatgcggacatgacttgctattcagtgactgcatcgctacttattttttatgtcttttagacttgggtgtttagaattatggatataaatatattgtagatctcaatttctaaaaaaaatattttatttaattgaacttaaaaatgcttgatctagagaaagtcctccagtggaaaagtttctactaaactttgttttggggaaaaaatgtttacttggcagctcttccactgtgcagttggtttctgccccttctcttcccccctacattgggccaaatttataactcttaatattaacattaaaagagctttgggtttgtctttatgtaggttgcagtaatgagagcagggttgttccttttgaatgattggccctttgggctaatcagaatgaggatttgttgaaatctcaaatatacatatatatatatatatatatatatatatatatatacacacacacacacacatacacatatatatacacatatatgtatgtgtgtgtgtgtgtgtgtgtgtgtgtatatatatatatcccatgttgtctgcaaagtgacagtttttagtgcttaatctccaaaattttccccctactgatacaatctaaagagcacaggcccaaagagaaaatgacaagaggctattgttccttcattcaagcacatgaaaggatcatgtgtactgtatttgctggaccattacaagctcttgaaggatctgcttgtgaagtactctgaggttattcttggaacacagagtgtgggagagtggggaagagccagctccagcctgagcaaagctgaagggtagaatgacagtccagtttctgaaaagagatattttaattttagttcagctttattttcctaagacgatatgaagcctacttttttatttttggctaggtctttgttttctagctttgtttccaaaaggatgcttaagaaaacagagtttttttcccctatccatttatctagggtagaaagtcactgccctgtgagaagaattacccttccaatcatgacagcttctattccaacttttcatatacctgactaacctgtaaacatatcccacaaaccacatacacaggctacctattaaaactctcccatatacctaacacatacacatgcacacacatacaaaatatatacatatcacacacttagagaatgacagatttcaggcaatggccaatagtcagtattgagtttttctaaccccagaatctggttgggctttatgatctaaaaaaatgtggtttagaaaagaggataattggtagagctgtagtttgaaaatatcaggtcaaagttgcaaacatacttatgatggaatcatttcatttttagttcctttcccagaaaagctgagagagcacactgttccagctgacttttttttccattaatagccgttctattcaacaaagagctgcccacatgccaggaaagtgctacagtccttctaagcttttaaaaatggggatcaagctacatgcagccagttggaatacttaagatctttatgccaagacacaataacctgacctgcagctgttgtattgcctccatagtatatctagccaaactgtagtctttgacacacaactttttagtcattcactatcaattgcaaagcttcatgctccagccctggctattctagtaccagtcctatacctttaaatgggacttaattcccagttataatcctggccgaattgatttgaaagtcaagtggctgaagcagcttgcatctcctttgtcattcccaatttcctttgggagaagtcaatgaaagagatttacttaagtttttcctccttatctcttgatcattaattattaagacatgggtaaaattcatttgtctcatgtcttttggttgattgaataatatagttactttttgaaagcccatcatttctttgtgataaaaccattttctcaatgtgacagccacatgtaaaatgtgaaactaatgtttcttagtatgtttaaaatcttcacaatcatatatggccctgcaatactccctgaattccttccctccaaaaaaaaactatgagttgcaaaaacactagttacgaattaatcaagaagcaaagagagtatgttaagtggctatgttctttaaaattttacattctaatagatgacttctaggcaaaattttggtatgattaccattaaacaggaaaacataccatgatttactttctataacttgctaatcactgtttcttttatttcaatttttgatattgttgcacaagtttatgactctttggtctttatattcaaaatttattaagtatcaattctttctttcaacaaatatgtactgaacacatgctgtgttagaacaactgtcttgggtagtaaaaagaggggaacactacaaattataatggataatattaatgaagggtggcatgaaataatcaagctttctcaaatcctcttaatatgtgattttatcaagtgacattagaaaaactgacatcagttcttgtctaattatatgtgagctgcaactaaaagatgcttcctttacctaaattatagaactcactggatcgcccttcatctctctccctccatctgaaatgtatgaattaaatcaggactcagctaggactgaatcaaatgaaaaagaaattttcgattaattgcttcttcaatgttagacctatataagtgatgctaaatttacaccagcaaactcctatcagacagtttcaaggaggatttgactcatgcataacccaggaaacatttcaggaaacttttaagacaacagtgtggaacacaatcactcttacttctatttataaaaagcctatcaaaacagcaaaatcctgttgcaaattccaaagacatcactttgcagcaggtggaaaacagagaggttgttagactccatcactttcagctggagttacaaaccatcaaattagcaggtggaaaatttatattctcagaagccaacaggagactgcctttttaaaaggtgtcatgaagccttctatttctccaaacaactcaatatttctctttaaaatggcatctctgttccttattctcttgatgacagtttgcagtgccattatagccagtgtattaaataccaggctttaatgggaagcacctttgtgctttcaaaggcaagacttgtctgtaattttaaattagaactgttggttgtattcttaccacaaccaaaacccaaagtttaaaggcttgattactctatattaggtctaatatgaattttcaccttctgattgcattactttttctgaaatctgctaactagtgctggaataacaaaaatgcctaagccaaaatgctgtagctctgcaccaacagcacagctcatcagatgttttctatagtagtaaagaatttgattgacttaattgaatatcagcaattttaatacccactagaattatggaagtatcagagtggaagtgaggacgcaataaaagcttaataagtggtggtgtcttctaggaattatgaaaaaaaaagctcagcagagctaagccagatcttattacatcataaagactagagttacaaatggcagccccaaacctagaaggggcagttacaatgtggacaccctttcagcccagttggtgctcacatctgctgaccaacattcatatcaattacatttttacagtctgtaagtcatttgatgctttagaaaataaaaacacacacctacagcattctaaagaaactattttgttaaaaaatttaaacacattttatattaaaataagtgatcaatgactttcatgattgtcaaaagtaaaaagtgcagacatttaaaaaagctcttctttcacattttacctaccaaatctagatattcaacgtgagtccttaaaacagtcacttctaaattttattttgactcctttcttggctttttcaaactggaccatgagacccccttcctaaacaatgcagttgttttgttttattctttttttccagaaattcaagctgaaacatttgatatgacctgtgttttacctggtgatcagttctcaggctagtctaagtctgtgctgtcttggcatgccttgggtttcctatcctgagagtggtaatgccagtagaatgatgggaaccaggagagtgaatacgaccagattcaaagcctaaaacaatatgtttcagtttacttttatatgtagattttttaaatattcacatctagcctggaattttagtaaatacagatacttgttgtatccatgggaaatgaggtcatttcaaagatgtaagtcacgttggtgactactttcttttacttgtgataaatatatcactatacagggtaattgcttttataaatttgatcctttgcattggcttataattcaagaaatgtcaacttcactgtgtcactttatgtcatctctcataaaagtttctggcaggactaaagtttcaaaggaatgtgatagaatttattttggataacatttgtattcagcatgctaatgatgtaactcctctctttatcattaccacggtgatagttaagttcattcgttaactcattttagtgacatgtgaggccatttaaatatttttaagataatgtatattgattagaaagggttagaaggagacaaatttatggtagaaattagccttgccattgtctaagttaatttatgtgacctgattgaacagttttagttgtaactttagagtagcttctttgttagaggatctctttcctttctcttttggttttctcccaatatttttatctgtcttgggattatcttaaaaggtatttattaatgagtatttggaagaaaattgacctagaaaatgtctcttttaaatttatctaggtacttgtatcaccagagaccttcatcaagtcctactgccacactggataaggccactacccccgacccttcttgtcagggacatggcttcctaataatggttttgctgttgtctctacataggggacctatggaaaaggagtttgaaatttctacctttgtagtacattgtatccaattttgttttgctcctccttttcatgtggtcaccaagcttttttccttagccattaaaaaagccacccctctttaaaacaaatttaaagatctatatacatttttgcaactttatttaataaaaaagagaagaaaaaataaaatctaaatctcaattaccctaaagtggaaaaacctaagtatctaacctaggaacttgttgcctggtggtggttgttgttgttgttgttttttaatttatttagtgttgatccttgagttatttaatggtatccaaatgatatctgaaagtgattgattttaagatgtaatagttggcaaagtcatttcatttgtgtctcaaacaaataaagcccactgccatgggttaccatctgaaccctgattcattaggcactagtcatgccaaatggggatctcagaatagtttaatcttttcaaagatactcacaatggccaactgtgtgtgaatactggaaagtttgagattcttctatattcttcaaatttatggtcctgagactaggagggatctccagaggtcatatggctcatcgatctaccaccagggaagactgtcacttaggcatgcccaacaggagagatcgccatctattcttaacatctctagggaaggcagtttccttggcaacacaattcagctctcttaggttttctcacaataagaaaatatcttggccagtctttgagggttaggcacctggcaacagttgtggtgatttgggccattgtactaggggattcaagggaagttgggtttccccctacatttggtgattattacattaatatatgatcattccataagtctcctaagaaatcagatttttaaagaaagacacggattcagagacaatggtctgtaacatgaccaacttttgacaaatatggctgtactaggttttcatttttgctgttgttgttgtttgtttttgtgattgctcttatgtcggtaggtaatgtcaggaaaagtgactgtttcagatccccagtacaaacatcagaactaggatcaaatgacttgacttttaagctgttccattttctaagaagttacaattacaaaaagtaagcattttctacattcttacttctaagtaatgaccttctcattaatctttccttggcttaaaatgacaaataagaatccaaagtttttccactcctcctgtgggagataggaatagttgtgaagagtctgatggaataaaatgactccagagatttacacagccaccatttgatcccagcctttgtccttgtgttatttaaacaatggcttcctgctttctcaggggtcaggaaaatgatttaaaaatttgtcttcttgacaaggcctgaaaacgaagggaggtgtcgtggagaaatggtgatttttctggttacatcacttgattcaagcactccctggagctttcaaagccttttttatctgctcagagttgacacccaactcagagtcagaactcaccagaagatgaggaacacccccgaaatcaatgtttcctttctccatgggatttttttcaatcttggtacagctgcatatctcccaaactcggatgctcttgtgaaatgacagccacatcagtgtggttactccccacaaataacactagggggaaatgaccttttttatttaaaaaaaaaaaaaaggctaatgctatagaatgatcatgtaaagaatgttgaataaaatttggcccatgttttaattgactctaggcacctctattgaaataagtctgaggcatagtttgtgaaacatgtttcaaaagtgtttgatgtataataaatgctagaaatttacagtacagaaatagtaaaaaaataaaataaaaataaacctgtagattacagctctgttcctaagaacctcagcctttattgtgtcttagtaaagttgatctgctttatttttagtttattgaatttctggtgtactagcctcttaagatagaacttttaatacatatgtactggttaatgcctgtttacgcagaaaatggcactttgttctttcagtgtgtttccctcagtgtcacagggtatatcaatttgatagatcatttgacatttgtcaaaaatacgtttcccattttaaaaatatgtataattggttgcatagacatatgtcactttttgcagtgtcttcatcttgatcatagttttagacatcaactatgtctcactttccaactgccatagaaatttggtacatttgcaaattctggtggaatctagtgagctgaatgtattggtagatcaaatgatccaaaggacttgggtgttatccttcagtctgtgttgaaccattcagatattgggaatggtccttacacaagggaagtcttttgagaatatttgttctcttattttttgtttgtttgttgctggcaaaaaaaaaagtaactttaaaaactcagaaaagccactgaactgtattttgtgaccttatgattagttttatctttcaactgatttttattgttacttttactcaatatcaacagtacttcaatagatatttattagttatgttcaatctaatgacttaaaacagttgaaaaggaggaaaatcaactccagtccacacatacagtcatgttacattaagatgtcatgttgtatgtcacacagtttctagattgatttctcttgtgtataagttataacatcaaaaatgccaaagggtatataaaataagctacaataatattcaacagaacttaacctggaccttatgttgtaataatttattcatattagctgtagtcttctgtatttatattttcagtatttattatgaatgacatggaaattcgtgtatttattgtggctttttattgcagtgtgtatatatatataacaaataagcatttttaagtcttatccttaagtttcttttattagtggcacttgtattatgctgtactttttattacatattgtacaatatcttgtccatttgtttgcagcagagtaaaaccggtttctaagttgta

SEQ ID NO: 5019 - DNA, 2129 bp, Homo sapiens
  ENST00000367306
ggcttgttcctgtttgcatgacaggaaactcctgaaatgcccctcgcacgtgcaagacgttttccgcggtggcggcgacagggcgcacagtgggaccgcagcacgagctcggagcacccccagagtcggcgactcctgcccccgcccctgccggccggccttcccggggcctaggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 5020 - DNA, 8475 bp, Homo sapiens
  ENST00000533402
aggcctgcctttaaaattccccttgattgagtctttggtggatcttacaaagactttggtgagttgcagagtctctcagtatatcacctggatggaggtagaggggcagagggccacgatgggcaggattgggcctctgggagaacagaagggccaaggcaaagcagaaaggagcagggaggtcctcggcaggggagccatctggaagatgtcaacttgcaggccctgaggtctgccctgggctgagttcctgggtctcctactggagagatcagccaaaatacacctctgttcccccaagcactctttgctttctgccttctctctggtcttggaattttcagttcaattgggatcttacaggaaaacaattccaggccaattcctgacttcccaccctagaagggaatgttggagcccttggcctgtggttccctctccctccttcttgggagctggtcccggggggaaatggtgggaagttccatatttggatggcccagagtgctggaatgagatggagatctccagagcaggacaagagggtccttatttagtctgaagtctccaacctggggcttagggtgagagaggagctggcagagggatggaccctttaaaggcaagaggatggcagttgcaaggaaaggagctgagagcttctccgagggtggtaaaaggcgtggcttctccagtggtatccctcggtttctatgttcaggacatgtttgaggatgcgtccaactgagatgctgaactccaatatttaaggaatatgatcaaaccgaattaggattacaggacaagtaaagaaaaagaatgcagttgaatctcttgagaggagtatgtgaaagttagaagcaatgatctcttgaagctggggcctgtccctcccacttccttgtctcccgatggtactaactttatataatactaataagagtagccaacatttattatgcatttgttgtatgcagggtattatgccaagtacttcacatgtcagatctcatttgattctcaccaccagcttttggggcagacattattatgttcatttacaaatgaggacacagaggctggaaaggcaaaaaaaacttgcaaatggctggaaagggagagagctgggatttgattctgggcagtctgactcttcatgaccccaggctctgaactgctttaactttatttttatttttaaaagttttatttatttatttatttttaaataaatagagacagggttatgccatcttccccaggctgatctcaaactcctgggctcaagtaatcctccagccttggcttcccactgctggaactacaggcatgagccactgcacccagcccaaactgttttattctggatagctgggcatagctcccctctgagattaacaggacgaaatatgaggcccacagcctttccagctcagaccattgcaatccctagttccttccgttccactctctcttaccccaggagtcaggaagttcttctgtgtctgaccctcacttcttcctgtggtaaagtgatttctgagattagaaacttcaaatcctcttgtgattagcatgagctgcatcccatttcaaagcccaccatgttgggcacttaataaatgttaaacatttcttatggggtatcacatcacctgcatctccccccgttggctccctgccaacatgcacagatagtctcttctggattccactgttgaaggcaggaaaactgcccttcttttctttttcctcctcccccattgggacatatggtctctgttgagggcagagtgaggaacctcaacaggcgtcctgtggcttggggtcagcctaggctgttgcctctgaaccctgtgttgcactgcagcctgaggaagtttaggggtgcagaggaccaaaggagacacatatggattcctggaagaggaattggtgttggccagcatttctagagtcggatatgcagatcccatccctctgtcctcccacccattggccatcccgcctgcctccatttgtagacagttcctgaaagatcaggatattatgtatgcaaagaggccagagagcttcagctgtaagaagcttgcaatgagcaagaaggtcaccccagcttcaactcaatgcgtccgcttccccttcccctccacagtggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggagtgagtaaaagatcccctcccaacctttttcttgagctctctcccccaccctgtattaggcctcatgtgtatttacaaccatttttgggtaagcaatggaaggctcagaaaaccagttatttaaaaggcagtcacagagcagtgtctatgtgtcaggctgctgcaggagctggggatgcagcagggactaaaacaggctgggctcctccctgcaaggagcgtgcattctatatttgtatgagagtcagagctgggaggggccccaagaatcacttagtccaatttcctctttttttgtttttttttgaaagggagtcttgctctgtcacccaggctggagtgcagtggtacaatcttggctcactgcagcctctgcttcttgggctcaagtgatcctcttgcctcaggctcccgagtagctgggagtacaggcatgtgccaccacacccagctaattctgtattttgtagagacagggtttcaccatgttgcctcctctttttatagatgagaaaatccagcccaggctcagtgacttgcctggggtcccacggctagtgagtgtcggagccagatcaggggctcagggcagcaccgttgccacaccagcctcactgtctcagccctgctatctctcactactgagaagaagtcatttccctttcttcgaaatgccatagggtgtcatcagccccaccacacccccctcaccccacggcactccctggcctctgggtaaatggtggctgttggcagtcagcctggcttgctcctcggcctggggggtggacggaaatgatggatgaattaccaagtttcagccaaggtcattgccccagtgggaatgattcatcagcagatttctcctgtaaagaatctgataatagaccagctgcaggaatgaggggcagaggagggcaattcttagcaaatggggtgttaaatgattctggggttaactgggtgaccgagggaagtatgatgttacaatggaaataacattgtgctgaggcttggtttgtccatctgtaaaatgggagatgaccctagaggccctagcctttgtgactttggcagagagaattgcgcgctgctctggcatgagatgaaggtagggtcatgccctctcagtgccagccccacctgtacttacagtgtaagtcacctcaccccatgcccttctccatgcagagcccctggccacaggcccaccaccaaccccaatgcatccaaatttgcccagaagattggtggctccgagcgctgcccccgatgcagccaggcagtctatgctgcggagaaggtgattggtgctgggaaggtaaggtggctgctgggcatgagagggatggggggagatatcttcctgaaatgtggattccagaacttttaaattggtgacctagctctgctcagggcagcctgagcactggggtttaacctcttctctttgtccctgtgggttgcatgtacctgtgctttccagtctccaaggagctcatatcagccatgagcagtaacatccccagcattgatggacaatgggcaattcatagggagtggcaatgatcaatctgtatctctaatataggagaacagaaagtaagggtacgtggatgggctgcagagggtccacaaagccctgaagattatatacaaagtttcatgggaacctgtctgtttcttagaagaagatccatagcttttattaaattttcaaaggatttgtgatcccaaaaatatacattctgtttcatgggatgtggactcccaaaaacccatccaaatacccccagggcagagattttcaaggttcagacctaccagagcctcctaggaggcttttttcacactgtttagaattgccgcacatgcccttcccccatgatattctgacagtagcccccaatcaccaatgcacagtgagaatcactgtagcaaatcaacagttcccaattgagctgatcacttccttcagataggctgcagtagagaagaggcagaactcttgcccctggggtttgcagtgtcagattagcagtcagaaaatcacagaagagatgtctttcagctgtggggccagagaggaattctggagcatcacgtgaggcctgagatagaaaagtgacttggccaagatcacacaacaaggttatggaatgtctgggcctggagcccatcttcatctcttctggattcaggttttggctttcaaggctttttgaccttgaggaatgggataggggaattgatcaagaaatgttaaacaattaacacttaggccagtgttagaatctctactctcacagtcatggttggacagagatggggattagtatccctgttgtacagatgaagaaactgggagtcaggaggattacataatttgcccagatccgctagctaggaaggggctaagccagactcaagcccaggtttgtctgactccgaagcccttgctcttactgctgttactactgttaatgctactttgggccatttagcctcttcaaacccatttccaaggctgcaaaatgggaggggatcctagcacggtgattaagagcttggactctagacagcctgctttgaatcctagttttgccatttattggctgagcgaacttgggaaaatttagccttcctaagcctcagttcttcagctctaaagtgggcctggatggtggaggaaatgcaaagtggaccaagtaatggcccctgacaaataaggcagtttttttttgtttgtttgtttttgtttttgttttcttttggcagaatttcacacttgtcacctaggctggagtacagtggcgcgatcttagcactctgccttccgggttcaagtgattctcctgcctcagcctcccaagtggatgggactacaggcacgcgccaccacacccagctaatttttgtatttttagtgaagatggggtttgaccatgttggccaggctggtcttgaaccagcctggacctcacgatccacccacctcggcctccaaaagtgctgggattacaggtgtgagctaccacacccaacaacaaggcagttttaatgattaaatgagatagtacatgtataatgtgcaatgtagtgcctggtatgtcctcagtacagttttgctattgttattattattgttgtttattttcagggattattttgaggtcacaatgaagatccttgccattgactaaaggatatgaaaacaggagacattaatattattattaagttgggttttttgttctatctcattatgagaatagaaaattattaagaatagctaagaatcactatttccattacttaggcaggctataaggtaaagttagggctgtactaaggagtaggataagagaattttgcattcaagtggaaaaggtagggagaagccccacctttctattgcctcgctcaagaaatgttgagctgggagtacttttgggtgcttatgaatgagcaaagggattcagcttattttggcagggaggtggctaggaaatatgaggagaggtgttggtctaggtgtgattcagtttttctccagcctagagagcttggggtagcagcccctgctttacagaggaggcagcaaaggctgggtgactattgaggttgcaccagcactgacctagacccaggtccccccatttcagctctctggaggagaagccaatgtgcaaggttaggcaaccaggaaatctgaggggatgaatttcctttctcatccaccagcctgggcactgggagtgtctttgcccttaaaaggccttgttttgtcttatctgactgctgcctgcctcttgcttttcctgggttaagcagagctgtctacacatcagcctcttagcctgcccagctgttgatgggaactggctgcggagaagtctgtctgtgcaacgtcccatcactgtgtacaaactcgggcctcactttttttctgggacagctgtttgccctgtgttacagaatgcatgtgaggactagatatttaaacatatgatgcctggccacagagaaggtatttgtaattggattctcctggaccagcccagcctctgaagttctagaattaggtgcctcctttgcccaaaggctatcagctattggaggggagggtggcagtatgtccctcactgggtagctgtgaacactaactgacttcaccagtgtaaagtgcctggcacagggcctggcacagaggaagccagagtcaatgttgtctagtatcactttggaaggagaataagtctatgaaatgcattaaactcagcagggaaagtcctaaggagtagtttctccaggggccacagaagaccctttgggtctctatgagaggccccaaggcaacacagggcagagaggtctttctggtgagggctgttcaagtactaagtgacagtaccaggaggagtgcaaagccctggctcacaccactgatctactggcaagatgggtctggagaaggctcatctggcccagccagtggggtaacagctactttggtgttaaacccaccccctcacctgccttttgtggtatagctggtgaccctaatcatcaggccattgcaacatagcatggaagatggtgcgaggtggcgtgtggtccctggccttctccctctactgccttgcaccataggccatgtcctcccagcagcaccagctgagtagacttcagaagtggcttgagcccttataccatggttatgtcaaagggagtgggcctggggtggagggtaccctcatcactggtggcagccattaactatttccttccctgcctagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccag

SEQ ID NO: 5021 - DNA, 4208 bp, Homo sapiens
  ENST00000527662
acaccagcgtctcctcacctgcaggctgagacttactgacacttttcaccctcttggccccacatgtgtggcccactggaggggagcaatggctggcagaaaaccaccaggtctggaggtcaggggctgggttctggcctggccctgcatctggccaacacgtgatctggaactgttttgtgggcctcggttttccttccagaagcagagaatcattctctatttctgagtggggcaagggggctctgacctctcccctggggctgccttttccctttatttccaagcagtatcacaagggcccaccaaagtggcatctggaagtatgtgtttccaacaaatccagtcttttttttttcttttccccttattggcttaccatgatatggtagaaatttattcaggcctgcctttaaaattccccttgattgagtctttggtggatcttacaaagactttggtgagttgcagagtctctcagtatatcacctggatggaggtagaggggcagagggccacgatgggcaggattgggcctctgggagaacagaagggccaaggcaaagcagaaaggagcagggaggtcctcggcaggggagccatctggaagatgtcaacttgcaggccctgaggtctgccctgggctgagttcctgggtctcctactggagagatcagccaaaatacacctctgttcccccaagcactctttgctttctgccttctctctggtcttggaattttcagttcaattgggatcttacaggaaaacaattccaggccaattcctgacttcccaccctagaagggaatgttggagcccttggcctgtggttccctctccctccttcttgggagctggtcccggggggaaatggtgggaagttccatatttggatggcccagagtgctggaatgagatggagatctccagagcaggacaagagggtccttatttagtctgaagtctccaacctggggcttagggtgagagaggagctggcagagggatggaccctttaaaggcaagaggatggcagttgcaaggaaaggagctgagagcttctccgagggtggtaaaaggcgtggcttctccagtggtatccctcggtttctatgttcaggacatgtttgaggatgcgtccaactgagatgctgaactccaatatttaaggaatatgatcaaaccgaattaggattacaggacaagtaaagaaaaagaatgcagttgaatctcttgagaggagtatgtgaaagttagaagcaatgatctcttgaagctggggcctgtccctcccacttccttgtctcccgatggtactaactttatataatactaataagagtagccaacatttattatgcatttgttgtatgcagggtattatgccaagtacttcacatgtcagatctcatttgattctcaccaccagcttttggggcagacattattatgttcatttacaaatgaggacacagaggctggaaaggcaaaaaaaacttgcaaatggctggaaagggagagagctgggatttgattctgggcagtctgactcttcatgaccccaggctctgaactgctttaactttatttttatttttaaaagttttatttatttatttatttttaaataaatagagacagggttatgccatcttccccaggctgatctcaaactcctgggctcaagtaatcctccagccttggcttcccactgctggaactacaggcatgagccactgcacccagcccaaactgttttattctggatagctgggcatagctcccctctgagattaacaggacgaaatatgaggcccacagcctttccagctcagaccattgcaatccctagttccttccgttccactctctcttaccccaggagtcaggaagttcttctgtgtctgaccctcacttcttcctgtggtaaagtgatttctgagattagaaacttcaaatcctcttgtgattagcatgagctgcatcccatttcaaagcccaccatgttgggcacttaataaatgttaaacatttcttatggggtatcacatcacctgcatctccccccgttggctccctgccaacatgcacagatagtctcttctggattccactgttgaaggcaggaaaactgcccttcttttctttttcctcctcccccattgggacatatggtctctgttgagggcagagtgaggaacctcaacaggcgtcctgtggcttggggtcagcctaggctgttgcctctgaaccctgtgttgcactgcagcctgaggaagtttaggggtgcagaggaccaaaggagacacatatggattcctggaagaggaattggtgttggccagcatttctagagtcggatatgcagatcccatccctctgtcctcccacccattggccatcccgcctgcctccatttgtagacagttcctgaaagatcaggatattatgtatgcaaagaggccagagagcttcagctgtaagaagcttgcaatgagcaagaaggtcaccccagcttcaactcaatgcgtccgcttccccttcccctccacagtggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccag

SEQ ID NO: 5022 - DNA, 5239 bp, Homo sapiens
  ENST00000532313
gccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaaggtaaggtggctgctgggcatgagagggatggggggagatatcttcctgaaatgtggattccagaacttttaaattggtgacctagctctgctcagggcagcctgagcactggggtttaacctcttctctttgtccctgtgggttgcatgtacctgtgctttccagtctccaaggagctcatatcagccatgagcagtaacatccccagcattgatggacaatgggcaattcatagggagtggcaatgatcaatctgtatctctaatataggagaacagaaagtaagggtacgtggatgggctgcagagggtccacaaagccctgaagattatatacaaagtttcatgggaacctgtctgtttcttagaagaagatccatagcttttattaaattttcaaaggatttgtgatcccaaaaatatacattctgtttcatgggatgtggactcccaaaaacccatccaaatacccccagggcagagattttcaaggttcagacctaccagagcctcctaggaggcttttttcacactgtttagaattgccgcacatgcccttcccccatgatattctgacagtagcccccaatcaccaatgcacagtgagaatcactgtagcaaatcaacagttcccaattgagctgatcacttccttcagataggctgcagtagagaagaggcagaactcttgcccctggggtttgcagtgtcagattagcagtcagaaaatcacagaagagatgtctttcagctgtggggccagagaggaattctggagcatcacgtgaggcctgagatagaaaagtgacttggccaagatcacacaacaaggttatggaatgtctgggcctggagcccatcttcatctcttctggattcaggttttggctttcaaggctttttgaccttgaggaatgggataggggaattgatcaagaaatgttaaacaattaacacttaggccagtgttagaatctctactctcacagtcatggttggacagagatggggattagtatccctgttgtacagatgaagaaactgggagtcaggaggattacataatttgcccagatccgctagctaggaaggggctaagccagactcaagcccaggtttgtctgactccgaagcccttgctcttactgctgttactactgttaatgctactttgggccatttagcctcttcaaacccatttccaaggctgcaaaatgggaggggatcctagcacggtgattaagagcttggactctagacagcctgctttgaatcctagttttgccatttattggctgagcgaacttgggaaaatttagccttcctaagcctcagttcttcagctctaaagtgggcctggatggtggaggaaatgcaaagtggaccaagtaatggcccctgacaaataaggcagtttttttttgtttgtttgtttttgtttttgttttcttttggcagaatttcacacttgtcacctaggctggagtacagtggcgcgatcttagcactctgccttccgggttcaagtgattctcctgcctcagcctcccaagtggatgggactacaggcacgcgccaccacacccagctaatttttgtatttttagtgaagatggggtttgaccatgttggccaggctggtcttgaaccagcctggacctcacgatccacccacctcggcctccaaaagtgctgggattacaggtgtgagctaccacacccaacaacaaggcagttttaatgattaaatgagatagtacatgtataatgtgcaatgtagtgcctggtatgtcctcagtacagttttgctattgttattattattgttgtttattttcagggattattttgaggtcacaatgaagatccttgccattgactaaaggatatgaaaacaggagacattaatattattattaagttgggttttttgttctatctcattatgagaatagaaaattattaagaatagctaagaatcactatttccattacttaggcaggctataaggtaaagttagggctgtactaaggagtaggataagagaattttgcattcaagtggaaaaggtagggagaagccccacctttctattgcctcgctcaagaaatgttgagctgggagtacttttgggtgcttatgaatgagcaaagggattcagcttattttggcagggaggtggctaggaaatatgaggagaggtgttggtctaggtgtgattcagtttttctccagcctagagagcttggggtagcagcccctgctttacagaggaggcagcaaaggctgggtgactattgaggttgcaccagcactgacctagacccaggtccccccatttcagctctctggaggagaagccaatgtgcaaggttaggcaaccaggaaatctgaggggatgaatttcctttctcatccaccagcctgggcactgggagtgtctttgcccttaaaaggccttgttttgtcttatctgactgctgcctgcctcttgcttttcctgggttaagcagagctgtctacacatcagcctcttagcctgcccagctgttgatgggaactggctgcggagaagtctgtctgtgcaacgtcccatcactgtgtacaaactcgggcctcactttttttctgggacagctgtttgccctgtgttacagaatgcatgtgaggactagatatttaaacatatgatgcctggccacagagaaggtatttgtaattggattctcctggaccagcccagcctctgaagttctagaattaggtgcctcctttgcccaaaggctatcagctattggaggggagggtggcagtatgtccctcactgggtagctgtgaacactaactgacttcaccagtgtaaagtgcctggcacagggcctggcacagaggaagccagagtcaatgttgtctagtatcactttggaaggagaataagtctatgaaatgcattaaactcagcagggaaagtcctaaggagtagtttctccaggggccacagaagaccctttgggtctctatgagaggccccaaggcaacacagggcagagaggtctttctggtgagggctgttcaagtactaagtgacagtaccaggaggagtgcaaagccctggctcacaccactgatctactggcaagatgggtctggagaaggctcatctggcccagccagtggggtaacagctactttggtgttaaacccaccccctcacctgccttttgtggtatagctggtgaccctaatcatcaggccattgcaacatagcatggaagatggtgcgaggtggcgtgtggtccctggccttctccctctactgccttgcaccataggccatgtcctcccagcagcaccagctgagtagacttcagaagtggcttgagcccttataccatggttatgtcaaagggagtgggcctggggtggagggtaccctcatcactggtggcagccattaactatttccttccctgcctagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccag

SEQ ID NO: 5023 - DNA, 890 bp, Homo sapiens
  ENST00000531916
ggcttgttcctgtttgcatgacaggaaactcctgaaatgcccctcgcacgtgcaagacgttttccgcggtggcggcgacagggcgcacagtgggaccgcagcacgagctcggagcacccccagagtcggcgactcctgcccccgcccctgccggccggccttcccggggcctaggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggaccccaaagtcaggatgttgtttgatcttctcaaacatctagttccctgcttgatgggaggatcctaatgaaatacctgaaacatatattggcatttatcaatggctcaaatcttcatttatctctggcctt

SEQ ID NO: 5024 - DNA, 1469 bp, Homo sapiens
  ENST00000532460
atcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctg

SEQ ID NO: 5025 - DNA, 582 bp, Homo sapiens
  ENST00000526256
agccgccacttccgagagcgcctgccgcccctgcgccgccgagccagctgccagaatgccgaactggggaggaggcaagaaatctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgag

SEQ ID NO: 5026 - DNA, 1149 bp, Homo sapiens
  ENST00000533432
gtgcgtgacccagggcgacccggctccccgcaaccgcctgcaagtcgggcagaacaatcggcgattctgcgcgccactgacgctcattgtatggcagagagatgagggcatccgtgccaccccctccctcaccctcctgctggggagaaaatgcccgcgggcggggtggggcaaacatctgggcctgaccttggacatctgtgtccctgagcgcagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacat

SEQ ID NO: 5027 - DNA, 568 bp, Homo sapiens
  ENST00000530120
agccgccacttccgagagcgcctgccgcccctgcgccgccgagccagctgccagtggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttca

SEQ ID NO: 5028 - DNA, 574 bp, Homo sapiens
  ENST00000526723
agccgccacttccgagagcgcctgccgcccctgcgccgccgagccagctgccagaatgccgaactggggaggaggcaagaaatgtggggtgtgtcagaagacggtttactttgccgaagagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgc

SEQ ID NO: 5029 - DNA, 374 bp, Homo sapiens
  ENST00000526317
agccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgc

SEQ ID NO: 5030 - DNA, 582 bp, Homo sapiens
  ENST00000524951
agccgccacttccgagagcgcctgccgcccctgcgccgccgagccagctgccagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtc

SEQ ID NO: 5031 - DNA, 1324 bp, Homo sapiens
  ENST00000458271
agccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagggattattttgaggtcacaatgaagatccttgccattgactaaaggatatgaaaacaggagacattaatattattattaagttgggttttttgttctatctcattatgagaatagaaaattattaagaatagctaagaatcactatttccattacttaggcaggctataaggtaaagttagggctgtactaaggagtaggataagagaattttgcattcaagtggaaaaggtagggagaagccccacctttctattgcctcgctcaagaaatgttgagctgggagtacttttgggtgcttatgaatgagcaaagggattcagcttattttggcagggaggtggctaggaaatatgaggagaggtgttggtctaggtgtgattcagtttttctccagcctagagagcttggggtagcagcccctgctttacagaggaggcagcaaaggctgggtgactattgaggttgcaccagcactgacctagacccaggtccccccatttcagctctctggaggagaagccaatgtgcaaggttaggcaaccaggaaatctgaggggatgaatttcctttctcatccaccagcctgggcactgggagtgtctttgcccttaaaaggccttgttttgtcttatctgactgctgcctgcctcttgcttttcctgggttaagcagagctgtctacacatcagcctcttagcctgcccagctgttgatgggaactggctgcggagaagtctgtctgtgcaacgtcccatcactgtgtacaaactcgggcctcactttttttctgggacagctgtttgccctgtgttacagaatgcatgtgaggactagatatttaaacatatgatgcctg

SEQ ID NO: 5032 - DNA, 567 bp, Homo sapiens
  ENST00000527573
agccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagggattattttgaggtcacaatgaagatccttgccattgactaaaggatatgaaaacaggagacattaatattattattaagttgggttttttgttctatct

SEQ ID NO: 5033 - DNA, 548 bp, Homo sapiens
  ENST00000529975
ctgctggggagaaaatgcccgcgggcggggtggggcaaacatctgggcctgaccttggacatctgtgtccctgagcgcaggtaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagctgtggggccagagaggaattctggagcatcacgtgaggcctgagatagaaaag

SEQ ID NO: 5034 - DNA, 581 bp, Homo sapiens
  ENST00000533188
agccgccacttccgagagcgcctgccgcccctgcgccgccgagccagctgccagtggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaaggtaaggtggctgctgggcatgagagggatggggggagatatcttcctgaaatgtggattccagaacttttaaattggtgacctagctctgctcagggcagcctgagcactggggtttaacctcttctctttgtccctgtgggttgcatgtacctgtgctttccagtctccaaggagctcatatcagccatgagcagtaacatccccagcattgatggacaatgggcaa

SEQ ID NO: 5035 - DNA, 758 bp, Homo sapiens
  ENST00000471596
cctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggagtgagtaaaagatcccctcccaacctttttcttgagctctctcccccaccctgtattaggcctcatgtgtatttacaaccatttttgggtaagcaatggaaggctcagaaaaccagttatttaaaaggcagtcacagagcagtgtctatgtgtcaggctgctgcaggagctggggatgcagcagggactaaaacaggctgggctcctccctgcaaggagcgtgcattctatatttgtatgagagtcagagctgggaggggccccaagaatcacttagtccaatttcctctttttttgtttttttttgaaagggagtcttgctctgtcacccaggctggagtgcagtggtacaatcttggctcactgcagcctctgcttcttgggctcaagtgatcctcttgcctcaggctcccgagtagctgggagtacaggcatgtgccac

SEQ ID NO: 5036 - DNA, 741 bp, Homo sapiens
  ENST00000481851
gcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcagtgagtacgccccaggccctattgctgttgccttggacaccctggacgggcctgcccccacaggctgggcctgtcaacaccccagggaactgatcccatgggatgtaaacagcttgacatttggctgaagcgcagctgggcagggaaacacttcagggcctctttgttccgttcagaagcttctttctaagggatgaactggccagagcgggtcggggtggcaggcgttcaggggctgaaagccaagctgtaaagacttggttaagaaaactttccactcagctctctcttctctctctccctgtcatgatttcaccatttcagaggaaaacactttcagccctttgcaccctaattatctcttgttcaaaggcaacagaggccacaacctcatggtgaagctgaatctggaggaagagtggggctcctccttcctcagccccttgcaggctggcctgttcagttcttcacttcccattcccactcagcctgggatgagaggaagagggagtacaaagttccctgatatctactcctaagaagccagagcaaggtttgctccagtcataagcctagatgagtaagaaatcaga

SEQ ID NO: 5037 - DNA, 1952 bp, Homo sapiens
  ENST00000340006
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagacc

SEQ ID NO: 5038 - DNA, 751 bp, Homo sapiens
  ENST00000264474
gttcactttggttccagcatcctgtccagcaaagaagcaatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattttacaaagtg

SEQ ID NO: 5039 - DNA, 821 bp, Homo sapiens
  ENST00000479204
atcctgtccagcaaagaagcaatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggttagagttcagcacctactttagcgccaaaagatgtatttctcattttatgtaaaatattccctgatttccctaccacataattccttccttacggttgtcctaaattaagatgcccagcatgattccttccaagtggtggactctcaaatttggtagatgatgtgacaccattttttttcttgtgaattcagaaagttttattacattgattcttgatttctggaaattgtatagaaaaagatttcataacagttcagggcatgctggatttgtggctgtgctgctgcttaggtaaggagggaggatcacgtctcatctgcctgaaggtgtggggctggaccacatggtatcttgaagctgattctacctcaaagctgtatgattctctatgtctaaattaaataaattaaagtaacgactcaaatcattagctgggaaaataatttaaaccttttttgcccttcaattaatataatgtaaatactattttgtaactcaaattagatttaacttgtggcactctaggcatagtttaaaagagtggagtatttaaaatagtttaaaagttaattttatagctctgtcaaaaaattacacaatgcattgatcgagttctaat

SEQ ID NO: 5040 - DNA, 4105 bp, Homo sapiens
  ENST00000331173
gcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccatttaaaatacaaaatcctattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgttcatactgctactttcccatgtttcctatatgcctcccctatattggagaggataactcgcgtttacatatgtgatagttatgcttaatactaattcacagagttggctcgatcattttgagattctagttgctttatctcaaagctttcactgaagggctgtaactgaaaattattaaatgttagtctttagtcaaatctctgcattgtttcatgcagaaaataaagatacaattaaggctg

SEQ ID NO: 5041 - DNA, 3591 bp, Homo sapiens
  ENST00000524295
gctagaatgcactgtctttgaagcattgagcaggccctcaccagacaccaaatctgctggttcctggatcttggacttcccagcctcataactaggcatcacaaatctccgagaggaacgcatccacttcctggcctggtagagcggagagcagaggtgggcccaggagtccaagaacttcccctaaggctgctagtcgcacccatctcttgagcagagacccaagagggcaggacaggaagaatggaagtgagatttggccccggtcatgttttccaaagtgctgacatcaggaaaataatagaagttaacgcagatatggggctgccactgaggagagagaagactgaaagaagcatatagataaaagtttcagttacctgaggtcaaccttggtctgaaattagattatctgagtaggctgaaccatcggtgaaaaggaggccaagcatctcaaaaataggacacgtgagagtatggagccaatgtgacactcaggtgagttagccttatgatccctaagcatgcagtccttggaccagatgcatcaggatcttctggtaagtgtgctaaaatataggctactgagacccaccctatgtctgtcaaatcagaatattctaaggaagcaggtcccagggaatatatattttaaagctccctaaatacacttcatgggctgccagatttgggaatcgcaggattaggtagctacctaaatgaagacacttaaatgtgccaaaagcttctctttcacccatccatttatccatctattcacccatccatcaaccaaacatgtgccagtatctggtatttgcttcatgacctgctactgctgtggtgggtgcaaagataaatgatcaatgttctcaaagagtcaatagtctaagagaatggatgaatgaagtataaataataaaagatgtgctatgaagtacgataggggtccagaaaagtatatacttattccagattgtggcagaagactctggagaggtttcgttttatataatggcatgaattccccttcagatccatctctaaatcaagcttcacctacttctgactgtttgtgttagataccaatcctatggatttctatagttttctggaattactttttacacactacagtagagttatgtggctgcttccatgttttacttagaagctgagagcttgataaaagtgaaggctgcatcttaatcatcaccttttcccccacctcctagctagggtctggctctgcctaagcagctgccattggtgctcaataaacattgaagaagttgggttgttgcactggttatgcaaagaaagggacacagtgggtgtaagcgtggggcggggagcaaagctgggaccaatcatggaacacctagaatttgaatcaaatttgggctttagtttttaggcaatgagcctaagacaattttggaagcatcctttgttcacaaaaaagttagaaatggtgagaactagggcagtctatcacaaagtgtgggagaggtaattttatatgtaaactattataaatcacatttgagttatgaagtgagacaattattccctttgcagtttcatttcattctgtctaattatttcagggagacattctgaattgggtgctagtattttaacacttctctaacactttctctttttaaattttgtttatttttaattgacaaataataattgtgtatatttatggggtacattgggcatggagggtgggttattctgtgatgtcttgacctgtgtgtacattgtaacacttctctaatactttctaatccagccatccccaacctttttggcaccaggaaccagttttgtggaagacgatttttccacagatggttgggggatgattttgggatggaactattccacctcagatcatcaggcattagattctcataagaagcatgcaacgtagatccctcacatatacagttcacaatagggttcatggttctatgagaatctaatgctgccactgatctaacaggaggcagagctcagctgataatgctttttcacctgctactgacttcctgctgtgttgcccagttcctaacaggccatagactggtaccagtccatagcctggggcttgaggacccctgctctatgatgtctatacaacaataaaattgcctaatgatacatttctcagaatgtatacccatcattaagtgacacatggctgcttgtgtatttttatatatagctaaatgtggctagattagatgtgatatctctttggatgcagggataggtgggcaagtttctaaaacacgaaactaactgtgtcttttctctgcttaagaaccttccatgactccctgttgttcataaccggataaattctaagctgcctaactcagaattctagcttagagatgtctacgcctggctgctcccaacagttagtctcatgtcctgtctcaaacatggggcttcagtaagaatgaaatttccaaggagaattttatattctgcatgcctttaaaggctcaagcctggagaccccccttcttgcctctcttacccttttcaccagggcaccctctattcatccttccagagccttctctgggaagtcctttcccaaagcccacttcccagcctaagcttagtgctatttctgtagatacccagaaacacatcaactatatgtacagtttaccctagtatgtcaaagttatagttactgccttaggagggattttgagcttttcatctttattactcgggcttctgctactgtgtcaagcaggtagttgacactcaacaaatgtttgtttagcctaactcagcagaacacatggagtgtgttcacatggagtaacctgattttgcttagtctgcaacatttcttgcatgcatcccctgcttgcagtctcaattacagtcatcctgtttcagttttcttaacttgtcactcccttcctctgataacttttgccatacctctgtataacatggcctactttttgaaaaagatttttttacattcacctacatttgtctcaaatttttttttaaaagaaactttgtattactaccgtcattgaaaaccttcatcacttggcacaaaagaaagtttaaaaaatacaacaaaagacattctactaaattctggctagacaaccttgcctgctctagtagatgcactgagaccattaatgaatctttcatcccaccttgtgtcatattctttgccacatgactttgggtctccctcactactaggcaagttcctgtctccatctcttgattctgaattcagccataatacttgctctccccaatgttgttttagcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaagtttattgttgaaaggc

SEQ ID NO: 5042 - DNA, 399 bp, Homo sapiens
  ENST00000524034
gtaacttgctcctcaccttccaccgtgattgtgaggcctccccagccatgtggaactattatctgagtaggctgaaccatcggtgaaaaggaggccaagcatctcaaaaataggacacgtgagagtatggagccaatgtgacactcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaagtttattgttgaaa

SEQ ID NO: 5043 - DNA, 425 bp, Homo sapiens
  ENST00000518431
catcaggaaaataatagaagttaacgcagatatggggctgccactgaggagagagaagactgaaagaagcatatagataaaagattatctgagtaggctgaaccatcggtgaaaaggaggccaagcatctcaaaaataggacacgtgagagtatggagccaatgtgacactcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaagtttattgttgaaa

SEQ ID NO: 5044 - DNA, 463 bp, Homo sapiens
  ENST00000523605
accccatgactggtatagaactgaaagtaaatcaagctggacttatgaaggattcctctctccattcgtggatgaatttgagtggcactggaacaagtttcagttacctgaggtcaaccttggtctgaaattagattatctgagtaggctgaaccatcggtgaaaaggaggccaagcatctcaaaaataggacacgtgagagtatggagccaatgtgacactcagatttgacacatacagaagcgtgaaaaactcttgtgtgactgggatagctcctctgcaatgagaacatgcctgggataatgtactgaaaagatgtgagaaatacatgaagcagagtccagtcatcccagccaagaaccagctgtgaatgtaaccgcatgactttgaggcaagtccagaccaagaacaaagaaccactggtcttaaagacagacctgcagattcctgagctaaataaaag

SEQ ID NO: 5045 - DNA, 772 bp, Homo sapiens
  ENST00000464926
ctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaact

SEQ ID NO: 5046 - DNA, 1805 bp, Homo sapiens
  ENST00000370938
ctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacactta

SEQ ID NO: 5047 - DNA, 1196 bp, Homo sapiens
  ENST00000346806
ttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgag

SEQ ID NO: 5048 - DNA, 598 bp, Homo sapiens
  ENST00000482383
gaagtgatactcctgcttcagccttccaggtagctgggattacaggtgcgtgccaccatgctcagctaatttttgtatttttagtagagatggggtttcactagttggccaggctggtctcgaactcctgacctcggtgatccgcctgacttggcctcccaaagtgctgggattacaggcatgagccactgtgcctggcctaaaaacatttatttttagattttagtatttttattttactagaaaatctaaattcatgttttctttgctatagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattt

SEQ ID NO: 5049 - DNA, 2044 bp, Homo sapiens
  ENST00000411986
tcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttgaaaagtttactgtgaaattctactgatttaagactatacttaatatttttaaaaaaataaatcagctgggcgcggtggctcacgcatgtaatgccagcacttttggaggataaggcgggcggatcacgaggtcaggagattgagaccatcctggctagcgcagtgaaacccccatctctactaaaaatgcaaaaaaaattagacggacgtggtggcgggtgcctgtagtcccagctacttgggaggctgagg

SEQ ID NO: 5050 - DNA, 10675 bp, Homo sapiens
  ENST00000433211
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacaggagaggccagagagtcctgtttatctgtaatacttcatgtacacttatcatccttatcttgaattaaaacactaacatgagctcctaacttggttttttaatagaaacaaaagacttttataaaatattttcccatttaatctccatgctttctttatctgatctaacctggcacctaaccaggcagaaatgtatgattcctgccatagcaaaaaaaccaccttttaatctctagatagctgtactcattgtcaacttattaggctaatatccattataaactaatcaaatttgaatagttaggctacttgctggattttgaaggtcaaccttgtttattaataaaatgctttcttaacattataaaggttacaatgagttctgatgccacatactcaccttttgggtttccaatgtgttagagagttctgtacttttgagtgttaggcctatccgaatacatatgtgaaagaagagttatcacccattgggaaaatgagacaacaaactatatcccaaagtgagttatattaataataacagaagtgtaagttctgtatgaccctatttttacaaacataaaaatacatttttatcagcttgcaattgtaattaaaaggaaaatggcagtttgaaaaatcttttgacgttgagtaaaatataactgcatgaactgtaccattgaactatgaagcagttaatggcaatgaagctggagtgattttaataacgttcttttaaataaaagtcactggggtcattttacaactccagtcactgtgttcattcctagttgagttcataatggacttcataatagtcttagagtctagtgtacctctctctgtcattctctctctctttttctctcccctgatgacctgcctctctctgtctttcaaaaatgtccttaacagaaactctttggaggccataagttttgttttcattttttctcattcatagagttctgattcacagactttaaaaaacattttctattctacattatcataatagtattatattgtacctttttacttctaaaacattgccattgatgagaggcgtctcagcaacgatgtaaccttagattgatgagaaaaaaatttacacatacaataccagttgatattaggagaaccagtttgggtaaaaggatgcatgaaacatagaaaagcataaagattgacagtacgatatgtgtggaatcttaagcataatggtatgggaaaagaaggatctatttaataggtcattattaattatgcaggaaatgttaaatttcttgtaatgaattatttcaatcttccaagtagctggattgcctgagctcagtgtaaaacttcctaggaggtgaaggcaataaactcctccctgttttgcaccatagactggcctacaataactattctgaacagaatgcactgcccagaagaaaaggcagtgaagaagggaattagggaattcagatgactctgtttttcagaattatctagatgattgaggcaaatagagattttcttttattgaaatgctgccatcattttctgctctaagtgtagatgttgcacgagtgacatctgtggtatatccttcttccagatagaagtataaatttataatttagtggggagaggaattttcttttaatcaccaaactaccagctgtatagaaaatttttttgaaatcaccaaactagcagttgtgtatcttagctcctaaagccacattcacaagaatcataagcatctcatttagaaaatctaatgtccaccggacccaacatcatctttccacatgttggagtttagaacatgcagtattggacaccaaaagaacagaaataacttgaaattatacaattaccaaataacctccatctctttgataaaaatgactttttacccaaagtgagatgtgaacaagttctcctctttaacccaggcagattttcagcttagctcaaagcaaactataattaaataaaacaataaaaattttaactcaatgaatatcctaggagttaatctgctgtggtaatcgatagtgacataaaaacaagatgcatagagctgaaaaaggcatctgtccacctgagtgaattcctgtagtaggcagcatttcaagatttagtttgattcaaacctgctgataaaacaaatgcttatatgcaagaaaaactagcagcaagatatgaataaatctccccattatgttaaaaactaatcagcatgacacatttatatttaggtatttcttctgcagaggattgccagaaatttcttaatgagagtgataatttggtgatccacctatgtaccttttgatgtctcatcacagagattagtgcttcctctgataatacatttgcttgatcctgctaataagaactcacctttctttttaacgaaatcaatttgtgttaatttacatagggaaaaacgttccttgagagggaggagaggggtgtttaccacccacaggagcagttccatccctggttacccaccagtatccctgccagatgttagactggaattagaatgaaaatttaaaaaaaaacgaaataataatccactaaatggccttctaattagagaaatttgaagatttctatcaaatataaaaagtgagaaatagaaatcattccctttaatttatgacaaattaaaattattgaagtaaaatgtttctaagtcagtttctggatagttcttgaatgagtcaagaaaaaactcaaacactaaatttctaagctaatttgttcattattcctttctgtttattatttattatatgagtgcaaattgcaaatgtattagaaaagacaatatagccttcacattcacaagtgtgccttctggcctttgaaatcttttaacataagatcaatataacatatttgttccccataaaaatctcttatgtacagggaataaggtcctccatagctacacagagacacccattcttgcagtctggcattcttaacacctttagcttcaaaggcagtcggtttcaatttcaagctaaaattgtgaatatacaattaagtgcgcaacttgggccttcagaccaaataattaatgctcctcaaattaaataatgagtggctgaaaagcctaatgtgtaacaacagagtaagtgacttcaacggcttcctgaaccttcattttgagggtgttctcatctcacccacctctgggctaggtatcctctgttaattgctaacaatttcctaccaaaatagtgcaatcaggactgcccatcacagcaaattactccaattaatgccctttcctcttctgtgaaccaaaaatatctctctcctgtctctcatctctatcccaggtataaattgactaataaattttacagagttttagtcaaaattatgaattttaatttccagcaacattattcctttagtctttctattccccaaaacattcttaaattttggtatcaaatgttcatttctgtcctagagattgtggttcccatggctacagatttttgtatagtggtagtatgagtggaataagatctgagacttttcctggtgatatccaccattctcttgtgaactcattgcagaataaacagcctctttcactttcattgtaagtagttctttaggttggcaaagcaggcaccagaatctgaatttgaatgaaatctgtactttcttttgttggcctattttttgccaagacagcctgcctattgtatatttaggaatcaaatattcattttttctgtttgtaaagccagaaatatttcagttaaaaagaatataattttatattattttaataattctttttaagtaaagtaggaaaatttctgccacctgagatgttactgtttttatttatatgaaaattccatttttttctttatgactcttttcccataccattatgatatgttcagcattagtattttccattttaccactaaacaaataagccaggactaataacaatagcagtttgagagtttttattttggcattttggttttaattaggaaagaaaacatggatgctattaaaactagttgtagttaaaaatgttttgaatgaggctactaacgctatcttagtcatctcaaagagaaagagaagaagtaaaattttaaatacctttttggcatttttaaccaattcatatgaacaaaaacatatattctattaaagcaaaataaagaatagtttaaaacactagtcttcttgcatgtgaatattttccccctaacagacaagatagaatccatttctggacactctaaaagaaagtaatgttaattgagagagctgtctccaaatggaactcaacctgaccagaatcccatccgcaggcaagagatgggctgtggggccgaccataagttttattctgagacgagatgctttatggctgctggctgcattatggcatctagcagtccccactggtttgtgggaacaaaacacatggattgatattcaatatgagtttggtaagttggagaaaaatggagacgatacggagtagtctaaaggcacaacaaataagaaggtgccagaggtagggaagggtctgagaggggtagttgcagaagcatttagctttcatagatgaggggagagttttttggttttatgaagattaggcagccctcctgaggaaagtattaaggatagaatgagacacttgtcttggtggtttggtgaagtcgtgtcgaaggcaaaaggatgaactacacatattttgagcatgatttagtaatattgtttgcaagttgagaaacagaaattcagccattctcctgactgatggtaggtgaaattcttcccaatattagagccaatctgggttaccatacgttcatatatttaacagctatttgttaaacaactgtgatgttccaggcactgttctaggttcttaggatacaccatataacaaaacaaatagtgatccttgccctcatgtgccagctctgtgttaaatgctaactattatcttattcaatcctccaaataaccctataggatatatatcattccacagacaaggaagctgagggttaaatgggataagaatcttgctcaaagtctcactggctttaaaatattaatatatattttacatcattcaagacagatatataattagctgaatattctcacctctattaactgaatgtagagtgtcaggtacatgggaagtaagttatttacgtgatctgaaataagaggacaacctttgccaaattacttttattaccatggagaagaaagcttcaatgaaatgcctgtttcagcccatcttcagtattggttggttaataccatttgttaacaccaatcctttcctcttttactgctaacatgtgactgtgtttaaaattatagattgcagcagagtgttggccaaggattattgtagtaggataaagtttccctgtatttgaaatttacccaaactgtagcaaatacatctttccttctttatggaggtcacacgtgtgcatagtatgtgcctgaatacaggtaaactttgtgttttaaaattacatggccttttttagagtcgactgaaggctagactcttcttgcccatgttgctggataggctttcaaatctcaggccttggagagttaaatgactttctgatatttcttacggtggagccacataagaaatacacacattcctagtttgagcaatggatgtgtatattggggatcttcacttttatgtatctggtagtcatgatggtgcctattcccaactgtaggaaaggaaagccctcaaggagaaaattctctttcaaaaaggctcagatttctaacaattatgtctaaatgtttcttcaatttagaacatgtacaaaagctacttaatattagcagagtagttcttgtgttttcatttcaaatgaaatattcccagttccaaagtttatttccttggcattttcaagaaggatggttatttttagttctggttatttggtgttggaggtctgtgacacttccttatacatttaaagccccctttgaatagttgtatcaatagttcaaaagcctgtagatatcttgcttttctattctgacagcccagcttctgcagactcaggccaaccttaggtatgtcacatcagttccccatctgtgtaaattacctgaacctctctgtggtattcactgagagttgagcttctactaagggatttccttgacctgggcttttaacaccagatttgtagtggagtgtttattagtaaagcaaaggagtaagtcagagatgctagcccctgctctcagttaaacagaactatcctccttcctgaatatttaaacataaaattaattttaaactactataaaaatcatgttccattgcttgccaaatcttataccattataatgctgtatttttacatgttagtatacattgtgtccatagggatataaatatgagaatttcagcaactgtcttgcagggttaagatgtgctatttgttgattttgcaaatttttctcatgtggtacagtccctccaaagaaaatttccttagacctaaatggtagcataataatttctcctccatatccgtgactaacaagttcctgaaaacagaagtagacatattttatgcccaatttagtacctaataattgaggcttaaaacaaaattttcttgggcaagttgggtgattaaatatgaattaaaacttctagagaaagatttccagatgcccctgttttccattttgattatggttttagtttcatagcaacttgggggaaaaaaatcatttactttatgtcgtattacaacaacaactttgacagcttaaatgtagtgacctctctgaaggtaatatgcacattataatttaggatgaaagcagatttaaactaagactttctgagatgaaataaaagtaaccaattcataatagtcatgtttattgcagcaatatcttgggaacttaagtttagtggcgtttgaggtgtttctgactatcttgcttgttcatttcaccctgctctgcagagacagaatatgattgaatgaactgcccattatattaatgaccagttcaaagcagttttgtgctttggctatagataaaatttggcaaaaatactgtaggcctttctggtccatatttatccttaaagtatttttgccaatcaataaaaatgaaatatttatccagaaatagaaaaagctctttcctatgacattgacatagaagcccaaatactccttgtttgagaccctgcatgtcttttgtgtttaactgaatcaatgattttttttagttgtgctcttaattgcattatttcacatatgtaacactgggtttgttttggttatatagtattattttactttattctaatttcaactcatgtcactctgtagctcattaagaatttgttcaactgaaaattaaaatgtgtgttaaagcaataaaaatgaaaagattggctatgcatttta

SEQ ID NO: 5051 - DNA, 1083 bp, Homo sapiens
  ENST00000373735
aagcaggaaagcttatttataacttgaagggcctcattatctgactgagtagtctgtctcttttttgatagattttcttttccatctttgtggtcagactaatacaccttctgtctacttccaatttactgtaaactgggtcatggaattcaggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgct

SEQ ID NO: 5052 - DNA, 470 bp, Homo sapiens
  ENST00000494580
tatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtaagcatgctagaactgtaactcactaaagtccaggagaatgaggctcccattctccatttatggttgaattgtacctaaataaaaacttttgacaccgtgttacaaa

SEQ ID NO: 5053 - DNA, 696 bp, Homo sapiens
  ENST00000330298
atcataagccaaattgtgagccatgatagtggcactgaatttctaaatacaagaaattgcttagacaattggtttagtatctgtatatgggcaatactctgtcctgcagtaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcag

SEQ ID NO: 5054 - DNA, 555 bp, Homo sapiens
  ENST00000545309
caggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacctctgtaatcaaaagtctgacctgggcctcactggagtaaaaatcaaattgttggaggaatgcattattttctggagtctctag

SEQ ID NO: 5055 - DNA, 2177 bp, Homo sapiens
  ENST00000343150
agccagtctcctccctcctagggtctggtcttgacgatagcatctcgtgttttggggatgcctttccttaccagattcttctaaagcccagctgcacccacccttaagtgggagataaggcttctgcccgcgggctctgcgttcgtccacccggccccacgtttgctgtggactaaacaggagccactggactagagtacacttgactctcggctctgcggaccaaaaattccaggactaaggaatagcaaggttaggctgaaacagtccacacagggcttgcggtaaacgtcttttcaggagccactcgcccagtgcagtaagtcgtgtacttagttgactcgagcgctccagggagacgcccgaccctactctgcgccgccccggggcaccagctctgcttcctccaggtccactgaggcaggcacgcccagctctgggacagtcagtaaacaagccacgaaccgcgccagggatcagagcacccagagtccccgcccagctgccggcacagccaatcgcagcgcagccaggcggcggggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 5056 - DNA, 1436 bp, Homo sapiens
  ENST00000340342
aagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttc

SEQ ID NO: 5057 - DNA, 975 bp, Homo sapiens
  ENST00000375894
gggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtgg

SEQ ID NO: 5058 - DNA, 988 bp, Homo sapiens
  ENST00000495822
gcaaccttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgta

SEQ ID NO: 5059 - DNA, 933 bp, Homo sapiens
  ENST00000342020
ttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttaagagataacagatacctttttcggaattcatatattagggctgggtggggtggctcacgcctgtaatcccagccctttaggaggctgagccaggcagatggcttaagctcaggagtttgagaccagcctggg

SEQ ID NO: 5060 - DNA, 908 bp, Homo sapiens
  ENST00000482054
ttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtgggg

SEQ ID NO: 5061 - DNA, 4107 bp, Homo sapiens
  ENST00000368985
gacaagggctcttcttgatggcttactgtatccactttgtccccaagaccatagggaaatgactagaggtgactgtactagctagattttaaatgaaactgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttt

SEQ ID NO: 5062 - DNA, 673 bp, Homo sapiens
  ENST00000472977
tgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatataattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaa

SEQ ID NO: 5063 - DNA, 390 bp, Homo sapiens
  ENST00000607427
cttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatata

SEQ ID NO: 5064 - DNA, 1421 bp, Homo sapiens
  ENST00000448301
aattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctca

SEQ ID NO: 5065 - DNA, 752 bp, Homo sapiens
  ENST00000483930
atcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtgatggagtcttgctctgttgccaggctggagtgaggtggcacgatctcagctcactgcaacctctgcctcctgggttcaagcaattctcctgcctcagcctcctgagtagctgggactacaggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggc

SEQ ID NO: 5066 - DNA, 650 bp, Homo sapiens
  ENST00000480760
atcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggtgtctactatgaaccatcctgtactcagaatgtgaatcatggtgtacttgtggttggctatggtgatcttaatgggaaagaat

SEQ ID NO: 5067 - DNA, 5970 bp, Homo sapiens
  ENST00000160373
ggacagcagcgggttaagtgccgcccgcgcggagacggctgagtccggagccgcggctccgagctcgcattcggatccgctagagcaggaagatggcgacggacggcgcgagctgcgagcccgacttgtcccgggccccggaggacgcggcgggggccgcggcggaggcggcgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccgttttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaaa

SEQ ID NO: 5068 - DNA, 4250 bp, Homo sapiens
  ENST00000446636
agatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcagaaaatacaaaaggtaaaatgtaccagagaggagccttcttgctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccgttttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttct

SEQ ID NO: 5069 - DNA, 5517 bp, Homo sapiens
  ENST00000441556
gctagagcaggaagatggcgacggacggcgcgagctgcgagcccgacttgtcccgggccccggaggacgcggcgggggccgcggcggaggcggcgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccgttttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaa

SEQ ID NO: 5070 - DNA, 760 bp, Homo sapiens
  ENST00000445366
gtccgtctggcgtcagcttaactcctgcctggcccgcttgggcacacctgaagcacttcttggaccaaaatatttcctgtcttgtcctgtagttcctgggcatgcccaagtgacagtgaaagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcag

SEQ ID NO: 5071 - DNA, 580 bp, Homo sapiens
  ENST00000435233
atgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctgcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttatt

SEQ ID NO: 5072 - DNA, 521 bp, Homo sapiens
  ENST00000482124
cctatatgtgttccgtacatgcctttgacaattaaagctctgaattccttagggttctcacagaagagagcatatgtttacccttgtgagaaaaaccactcataagcttcccttgacattttatttcattttttgaaactaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctgatggggaaactgaacagagagaggtaaaatgctcaaagtcatgcatctagcaagtgatgaagccaggattgtgcaagtctctgatgtgtatgagatcaatctgaaactaatactactggtataaaacattaaacataattttgcttgctgccttaatttcgatgacctttttaaataaatgagttggaactatgacccttgac

SEQ ID NO: 5073 - DNA, 530 bp, Homo sapiens
  ENST00000416239
catgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctgatggggaaactgaacagagagaggtaaaatgctcaaagtcatgcatctagcaagtgatgaagccaggattgtgcaagtctctgatgtgtatgagatcaatctgaaactaatactactggtataaaacattaaacataattttgcttgctgccttaatttcgatgacctttttaaataaatgagttggaactatga

SEQ ID NO: 5074 - DNA, 576 bp, Homo sapiens
  ENST00000467088
ctcttgtctttatagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggtatcagcagtcctatgacggagagaaagtgaaatttctgggtttatttatgtttgtgggtttcataacctgattcttagttcattgattaagcacattcaaagcttacttgtggcagctgccggtgctgaaaaacttgagtattcacaatgtagccattatgtaat

SEQ ID NO: 5075 - DNA, 578 bp, Homo sapiens
  ENST00000434890
agatcgtaaacaaaacccaggacgccaggcagatttctgtgttaacaagaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaaga

SEQ ID NO: 5076 - DNA, 379 bp, Homo sapiens
  ENST00000487820
actcaccctcccacaggtcactcttgtgccatgcgcacatggcttactgcaggagcgctacgggaaggtgtgtggtgggaatcccatgcagagagaacagcaaggacaaagaccccgaggcaggaccatgtttaggaaactccgggcatccagcgaagctaagggagtaagcaggatcaaagtaggagacaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaa

SEQ ID NO: 5077 - DNA, 570 bp, Homo sapiens
  ENST00000454375
gctttctggagagggagaggagagatgtggaggaaggtacttggggtgagaggagctgagcctggcaatggaaggagaaacggggaggaggactgctaatttccacttgtaaaactgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgc

SEQ ID NO: 5078 - DNA, 470 bp, Homo sapiens
  ENST00000412853
aaaaggagattgtatagaaagttaggagctgaggggctggtgccacgttctaaaagaaaacaggacagacaaatcgttttcatctgagaattgtttttggagaaacactagagtcaacgatagaataaatcagagccagaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaaga

SEQ ID NO: 5079 - DNA, 1274 bp, Homo sapiens
  ENST00000318978
ataggaacagccgcggcggcccggctcgcgcgctgcttgcctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcggggccaggactgcgctcaggatcccgccccggagcccccagcccgggggagagggggagggagttgggagaagcccagcccctccccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaa

SEQ ID NO: 5080 - DNA, 1660 bp, Homo sapiens
  ENST00000379445
agacacactgctaggatactgcctctactcgctgaagcagaatcctctgaagagttgctgaggcagaactgaaatcatggctcacctcaaagaagcagcagtattggccgttaatgatgcctcacacagaaagacgatgctcctttaactcggggttttaatgggaagtttctaagcctgaaacaacagctttagacctggggtgtgccatcagctgccttgcagctaccactgtctactgctttcacacagcgtggtcgggaagaatggaaactaaagaggcttgtaactacctgtaactgttccaccaggaaatggatcaagtgtttgttcagccagagccagtattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 5081 - DNA, 552 bp, Homo sapiens
  ENST00000514851
aaaggttttctgaggggaagagtggtgagatctgggcttaaaaagatgaatcgagatgcagtgtgtaggaagcatgggcaagggatgaggaacgccactttgaaaattactaaaactaaagcaagtgactaagagtgtgaatgaccctggctgcaatgactacgcctgctgggcttctattaaaattagactctatttcctgagcacccacaaatggacctgacaaagggaagacacagatgtactgcgtgatgaggaaagcctatcaggattaaaatatggctgtgagtaactgtggtccttctttatacttaaaatagctgccatgtgttattatgaaggcttctgatggtggtatcaaaatcctttgaaataatagacttgcacagatttccctggtcatctaaaagaaagatgtcattattcagttaaaagcaaacttgcacattttctaagaatcatttttaccaaaaagggacattttactgcgagacagacatttaaaaatttacatgtcttgagatatttttgtattgtggtagcaaaatgatt

SEQ ID NO: 5082 - DNA, 1458 bp, Homo sapiens
  ENST00000395322
ggcttaaaaagatgaatcgagatgcagtgtgtaggaagcatgggcaagggatgaggaacgccactttgaaaattactaaaactaaagcaagtgactaagagtgtgaatgaccctggctgcaatgactacgcctgctgggcttctattaaaattagactctatttcctgagcacccacaaatggacctgacaaagggaagacacagatgtactgcgtgatgaggaaagcctatcaggattaaaatatggctataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 5083 - DNA, 1208 bp, Homo sapiens
  ENST00000620385
ataactcagcctctccagagtgcagccaccatgacctccgcagattgatgatggaagaaaagaaaaccaggatatcctgtgctctggcttccctggaccatggatggaggacagcccatcccctcatccctagtgccccttgggaacgaatcagcagattctagcatgtccctggagcagaaaatgacatttgtttttgtgattctgttgtttattttcttgggcattctcattgtccggtgcttccggattcttttggatccatatcgaagcatgccaacctctacctgggctgatggacttgaaggcctggagaaagggcagttcgaccatgcccttgcttaggagggatggtgtgggatctcctcctgaggagatgaagtgctttgtgtcttggtgaggattccctttatttagtgttctcaacaaatcaaatttaaacaatatttggtcccaggaccataatccattattccataaatatgcagttgggttaaagacatttgaggatgttggaaatggacacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctgactaaagaataaaagactagaaaggatctcatatgaatctggtgacaaggccaggaagagatttccttgctctaattatgtctatatttgttttatttcatgggcacctatctgggtcctgagcagaatgaggaagattgtgctgaatggacccaaagtagtttcttgttttctcccaaagcagggagctttgggaagcaatggaaaagcttaaaagagatgattctgtccttggtaaatgtgagtgagaatagcgttttgtttttcaagtaaaacttaattcaaaggctacaaagttttaaaaactatttaccaagccaactacattatatgtattcatattaataacatgtgtagaggtagctatacattacttgaatttacactttacacaaatgatttaaaaaataggttgcaagtgcagcttaaagttttttttcaatgaaaagttaattgtttagaggagaagacttttatagtcttcagaggaatgtgtatttatgattgtatatagtcaccaaataaaacttttcaagaaaca

SEQ ID NO: 5084 - DNA, 5254 bp, Homo sapiens
  ENST00000265348
gtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattata

SEQ ID NO: 5085 - DNA, 749 bp, Homo sapiens
  ENST00000478630
cactgatcgagaggtaatacattcacatggttcacaaatcaaaacgctctaacaaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcag

SEQ ID NO: 5086 - DNA, 5504 bp, Homo sapiens
  ENST00000535468
aggaggtgctgcgtcgccaaggtggcatcctcggctccgccccggcgctctcccagggcccctagctttccgctgggtcgggcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcaggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgatt

SEQ ID NO: 5087 - DNA, 3321 bp, Homo sapiens
  ENST00000006053
attataaaaagccacagatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaatcaa

SEQ ID NO: 5088 - DNA, 3313 bp, Homo sapiens
  ENST00000563383
ctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggaacctctttgaactcaggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgt

SEQ ID NO: 5089 - DNA, 563 bp, Homo sapiens
  ENST00000564948
gccgcctgcctggcccccgccgggactcttgcccaccctcagccatggctccgatatctctgtcgtggctgctccgcttggccaccttctgccatctgactgtcctgctggctgcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaa

SEQ ID NO: 5090 - DNA, 5796 bp, Homo sapiens
  ENST00000565912
acaggctccccaggtcagttaaacaatcttcctggcagaaccaagaactgagccgggccaggaccattcagggaccgtggcagagggtggggactttggagacaggatgactctgtggctctttaaagccctggaggtgggcaatggcttttcccatcttggatttggggagcacagaatggaccttctttcctatccattgggcagcctcccttgcctcctcctgtctctggtcactcaggggcaccgtattttctggggcttcccaaagaagacacctgcaggccattttaggggactgccacctggctccactcaatagggcctggggaggctgcaggtgagtcagtctgaggttccattgcagaaggagggtggccagcccacacagtgacttttatatcctggttactcagagagaaaggacagccctgtgacctggggagcccctcctgcacacagcccccaaccccctgaagctactagtgcttctccttgatgactcaacccagacctgccggccctaaaccaccttcccacaaagcagggtgggccaaagctaagggggagcgatggagagaggaagcagcagactctacaaagtctctctgtgtgtgcaagcgtgcatgtgcctgtatttgggaaagtggtgtatgtttgcatggccacatatatgtaaatatttatgcatgagcagttcgtgttctggtggagcccagggatgccctgggggtttcccaggctctgaagggctagataagatcagcttgctctcttgactgccctggtctccagatgtttgcaaaaccctctggggtcttgcttttgctgcatataaccttgactcagatctgaaactcaagctcttccttgttttttatactcatcctccttgagctcaagctaagcagaagaaaatttgctggagattatagaggaagagaaaaggtggaaattcaatgtaaacaacttcaaatgtttatatcaaatagttgggtttatttgtcctgtcccggggtttctctctggttccacgtgacactcagctactgcctgccccttccgccccactctgcccccaccttattcataccgtccatctccaaccctcctccttactcttcttgctccaggaatttcaaatgcctcttccctcctaggcaggatgactcagtacctttcagcaactgctctcgggctcattctggctctcagcagcagaacaaaggatcatctattcagcagaccccaccttccttagaaagcagttgtacttatatattttttaaaaagtttattgctgggcatagtggcttacatctgtaatcccagctattccggaggttgaagtgggagaatcacttgcggtcggggttcaagaccagcctgggcaacatagcaagaccctgtctcttaaaaaaattagccaggcatggtagcaggcacctgtagtcccagctacttgggaggctgaggcaagagatctcttttttttttttcttttttttttgagacggagtcttgttctgtcacccaggctttagtgcagtggtatgatctcagctcactgcaacctctgcctcccggattcaagcaattctcctgtctcagcttcccgagtagctgggactaaaggtgcacaccatcatgccaggctaatttgtgtatttgtagtagagacaaggtttcaccatattgatcaggctggtctcaaactcctgacctcagatgatctatctgtctcggcctcccaaagtgctgggattacaggtgtgagccaccgcacccggccaggaggatttcttgagcccaggattttgaggttgccgtgagctaggattataccactgcactccagcctgggcaacagaacaagaccctatctcttaaaaaaaaatggcagcgggaagaaataaggcagaggtgaggggataggcaaggccacaggcccggtggggactagagcaggagaacctgctccatcacttgctggctgtgtgaccttagcaggtccctgtcactctcagattcatcccccctgctgcacaatggaccacttaattttaaaaattaactcgggcatggtggctcacgcctgtaatcccagcactttgggaggccaaggagggcagatcacctgaggtcgggagtctgagaccagcctgaccaacatggagaaaccccgtctctactaaaaatacaaaattagccaggagtcgtggcacatgcctgtaatcccagctattcgggagtctgaggcaggagaatcgcttgaatctgggaggccgaggttgcggtgagccgagatcatgccattgcactccagcctgggcaacaagagcaagactccaactcaaaaaaaaaaaaattaaactcttaatatgtgccaggcaaaaagaactctataaataagaattcacgtttcttattcttacaacaagactatgaggtagatgctatttttgttcctattttacaggtggggaaactgaggcatagagaagtttggcaggggagggaggctgagtcaaaggccttgaaggccagggtgtacaggggatcagttttggcttgggtggtgtggccgggacaatctggcacggggttgggaagccagatgcccacagacatccctgctgaccaggaacctctttgaactcaggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtg

SEQ ID NO: 5091 - DNA, 3106 bp, Homo sapiens
  ENST00000399220
aatactcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcca

SEQ ID NO: 5092 - DNA, 699 bp, Homo sapiens
  ENST00000435290
actttgaggagaagagctgtgtgtgccccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgt

SEQ ID NO: 5093 - DNA, 559 bp, Homo sapiens
  ENST00000412814
gcttttgtcctgtggccttctggccaaaggcagggaaaggtggccaaacactgagaccaagaacaaagaaagaaaactgctggtggacttcttccaccatgagcaggccaccaagcccgcagcactgcactgcagcccccagctctgtcctggggttgggggaggtgaggaggggcaaggtggggagcacacagagcacccgctgtcctcggaacaccacagcgactagaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccg

SEQ ID NO: 5094 - DNA, 3255 bp, Homo sapiens
  ENST00000541347
gcttttgtcctgtggccttctggccaaaggcagggaaaggtggccaaacactgagaccaagaacaaagaaagaaaactgctggtggacttcttccaccatgagcaggccaccaagcccgcagcactgcactgcagcccccagctctgtcctggggttgggggaggtgaggaggggcaaggtggggagcacacagagcacccgctgtcctcggaacaccacagcgactagaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 5095 - DNA, 3215 bp, Homo sapiens
  ENST00000542107
actttgaggagaagagctgtgtgtgccccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 5096 - DNA, 3151 bp, Homo sapiens
  ENST00000358309
ggggcgggccgtgcttaccaggccgtggacttaaaccaggatgagagaacccctggaggcgtttaagttggcagacttggatttcaggaagagctctctggcttctgggtggagaatggccagtggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 5097 - DNA, 3532 bp, Homo sapiens
  ENST00000374429
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccctgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgta

SEQ ID NO: 5098 - DNA, 665 bp, Homo sapiens
  ENST00000395793
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccctgcaaaaggactct

SEQ ID NO: 5099 - DNA, 470 bp, Homo sapiens
  ENST00000374426
cccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaaggggcgcagagaagaaaaagtggggaaaaaagaaaagataggaaaaaagaagcgacagaagaagagaaaggctgcccagaaaaggaaaaactagttatctgccacctcgagatggaccacagttcacttgctctcggcgctttgtaaatttgctcgatcctcctcc

SEQ ID NO: 5100 - DNA, 1857 bp, Homo sapiens
  ENST00000343575
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggta

SEQ ID NO: 5101 - DNA, 1052 bp, Homo sapiens
  ENST00000395794
ccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaacctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgca

SEQ ID NO: 5102 - DNA, 803 bp, Homo sapiens
  ENST00000496375
atctaacggccaaagtggttttggaaaaaaaatgcacagaagacacctactcccaccagcggagttccggagccctcgcagcctcctgttgaccgctcccgcctaatgcagccgctgaccgcccactccccgacggccaggactccccagggacagggacgtgtccccagggcaggcccctggatggacgcggcgactgaccccacttcgctggacgctgtgctgggaaggacacagagaggtggctggggcagcctgcggtcacaaagcgaggcccaaaggggcgctctcctcacccccacgtctcctgggtgccgacctgcaccctcccttcgccaccggactggggccatctgggatgtctcgggggtatccggagggctaagcaccgccgagggacggctccgtgggaagagttttctggacccagaaggcagacgccagtagtactgtcctaggagtcggaggtcggggtgggggagttctcagctctttgggtcgcacggagcttttcttggggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaa

SEQ ID NO: 5103 - DNA, 596 bp, Homo sapiens
  ENST00000488591
attgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtgtaagtcttgaaattgaacatcatctaacgaacatagttgcatctaacgaacatagtaacatctaacccgagtcttattaaaggtgtagaggtgacaagccaagtgtccaaccttgaacttggcataattagtggcagctattcttatcatgaggacctttagtatgccaccaggcattaattttaaaagccgctcttggcctgggcaccctgctgtgctcgtagtagttctctcttctttccaaacctgtgttcttcagcacagcacagctggatgctggagaaactatgggcttcaccaaggttttggctgaagcctagtaaattagccagcccttagctaataacagtg

SEQ ID NO: 5104 - DNA, 404 bp, Homo sapiens
  ENST00000395795
gccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctag

SEQ ID NO: 5105 - DNA, 1760 bp, Homo sapiens
  ENST00000512158
gcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaccaaaa

SEQ ID NO: 5106 - DNA, 1971 bp, Homo sapiens
  ENST00000337225
aatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacc

SEQ ID NO: 5107 - DNA, 2538 bp, Homo sapiens
  ENST00000296027
ccatgagttcagggaatttccccagcatcccaaagcttgagtttcctgtcagtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcaaggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcgggagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggttcatagtctttattttgtcctttgaataaacattaaaagatttctaaacttca

SEQ ID NO: 5108 - DNA, 1895 bp, Homo sapiens
  ENST00000409817
ttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 5109 - DNA, 1682 bp, Homo sapiens
  ENST00000241393
cgcggccagaaacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaact

SEQ ID NO: 5110 - DNA, 1485 bp, Homo sapiens
  ENST00000466288
attctgtgcacaagtgcagagaaggcgtgcgcgctgcctcgggactcagaccaccggtctcttccttggggaagcggggatgtcttggagcgagttacattgtctgaatttagaggcggagggcggcgtgcctgggctgagttcccaggaggagattgcgcccgctttaacttcggggttaagcgcctggtgactgttcttgacactggatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatg

SEQ ID NO: 5111 - DNA, 4655 bp, Homo sapiens
  ENST00000398000
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcagggcctggccagcccgctcctgcgctgcccttcgcagcgactcctggatcgcgtggtcaggcgctatgcagaggtggccgacgccggcagcatcttcatggaccacttcaccgaccgtgacaagctgcgcctgctctacacgctggctgtcaactcgcaccccatcctcctacagatcttccctggggctgagggatggccgctgcccaagtacctgggctcctgtggcagattcctcgtcagcaccagcaccagaccgctgcaggaattctatgatgcacccccagatcaggcagccgaccttgcctaccagctcctgggtgtcctggagtctttgaggagcaacgatttgaactatttcttctacttcacccacattgatgcaggcatgttcggcgtctttaacaacgggcatctgttcatccgggatgccagtgcagtgggcgtcatcgacaagcaggaaggcagccaagaagccaacagggcaggagagaataaagacatttttagctgcctggtttccggctgccaggcccagctgccctcctgcgaaagcatctctgagaagcagagcctggtgctggtgtgtcagaagttgctgcctcgacttctccaggggaggttcccctccccagtgcaagacgacatagactccatccttgttcagtgtggggacagcatccgcccagacccagaagtccttggggccgccagccagctgaaagacatcttgaggcccctgagaacgtgtgactccagatttgcctatcgttacccagattgcaaatataacgataagttctgaagggctggtgtctagctggccttggggacaacacgcttggctctccattctcccagtcgggttgctgcaaggtagaaagaagcagctcttttttaaagatgagaagaaaggcacactcatttcttagggactgagaggggagttgtgagataccacgtggctgtctctgctggctgggacgtcctggcaaagcccgcggtgggcatcagaagacctgggtgtggacgctcactcaatgtctttgagcctcagtttcctctgttctccaccagactctcctgagggtgaaagaagacacagatggagccaccactgagcatatatcccaagcatgggtcttgggacacatgctcaccacctccatcccaggtggttacaaagtgtgttctggaaaagcacagaggcggggagcatgagaaagagctgctcaggtcaggaggctggagtggagggaaggcaggggaaggacaggctccctgccactaccactttagactcggacaagaggggcccccttcctgctccctatggccctgcgtcactccccacaccatcgcgggatgaggagactgcaggccaaggggacatgcctgccaccacctagagcctggtacctgaggctccatacacctgcgcatggggcttctcgtggtgtgggaagaagccaggggtaagaagataaaggggggccggcgggggaccaatgtgttagcccaagtcttccaagaatatgtgtcaagatagagtgaatggaacaaagatttgttaggggaaatgattgtgtgtaaggaaagaaggagggagccggagaagattgggaggaccagtaagtcgagctgcaagctgagccccggtgaaggagagaatgtctggcaggagcttgctaagctcaaaatcaaagaaaggttcagcaaggctgtcagggtgtcctcaagacaaaggcagccatcagaagagccccgtgtctcccacaaatagaccccgttagcatccctgctgcactcagtggttggcggaaacagcaaagatagatttcagagcacagcagcaggggtccctggtcagccccgctccctagagcaggagatcttgagtgggagaacattcttgttgtagccacagctgaggccctggaccagctctctccacaccgcatgctccgagttgggactctaaggagtctaggaattttcattcaaacttggccttacaggtcactcatcagaaaaatacttttttcaaggtcaaccaatagaacatactttattcaacagtttgttagtttgctttttaaatatttagccacatggtatgtaggcttccatgtacactcttgccctggcccctgaaacataagcagggggctcttctgtacatttgcccagcttccctgccagcctttaaccccaggaacctctcagtctacctcctcttttctgcctctgaatccctacctttaaagtcagaacaggccaggcccggtggctcacgcctgtaatcccagcactttgggaggctgaggtgggtggatcacttgacatcagtagttcaagaccagcctggccaacatggtgaaaccccatccttactaaaaatacaaaaattagccaggtgtggtggcgggcacctgtaatcccagctactcaggaggctgaggcaggagaatcacttgaacccaggaggcagagtttgcagtcagccaagatcacgccactgtactccagcctggatgacacagcgagactccgtctcaaaataaataaataaaaataaagtcagaacacctggcttaataggcctcactgtgcagatgaggaaactgaggcccagggaggaagagcgatctgtggagatatttctagaacccctgcaagctgagccccagtgaaggagagaaggtccagtaggagcttgctaagctcaaaatcgaagaaaggttcagcaagactgtcagggtgacctcaaagcaatggcagccatcagaggagccccattgctattaggaggctcctattgccctccccttcagcctctgactttcacctgtgctacccaattctggttccttcactcccattcaaaaatggaccccagaaaagccttattttgtggagtacctagttcccttttgggtttgtctcttgactgctacgggcattgccccagggcaaccatgacagtgaagatgactggccaagcttgtggactggccagcaagcttgggctgcctgagacgctttgaaatggctgccttctgagttggtcttgagggtgaagactgaccacccttctcacctgcacagtcacagtccctctcctgctggcctgactgcagctgtcctcccagctggccacctgaccagagaccaggagagaggccacagcctccagaccctccagagtcccacggaggaagaaggcttaccagagagaccctctgatgcatgagccaggccccagcccttctccctgcatccaggtgtgtttccaccgcaaaatgcctccacacaatgagcgactttggccctgcgtgggtcagcatgtggtctgaggtaaccctcaaatgcctccaccacacatctgtccacctgcacgggttcaaggtaagcacttgcccccttctctcctccagaccagtcgcctgaaattctgagcaacattccttcaagactatcatgtaacccttggtgatgctgagtccagacaggaaatgcagacttgggacccacctgtatcagcagaaagaggccttgtgccccgtttgtccgagtcccagaacggagcaaatgagaaaaccggcgagctgtcccccgaggagctgtagggagattggtttttagtataaattacaataaaattttgtgtatgtgtacagctgtgttcacatccacagtgtaagctgtgatatggtttggatgtttgtcccctccaaatctcatgttgaaatgtgatccccagcattggaggtggggcctgatgggaggtgattgggtgatgggggaagttgcctcatgaatgacttggtgccctcctggaagtgatgagtgagttctcgctgagctcactcaagatgtggttgtttaaaagagtgtggcacgtccctcccccaactctccctctcactcccgctctcaccatgtgacacacctgctcccccttcgccttccaccatgattggaagcttcctgaagcccttaccagaagcagatgccagccccacacttcctgtaccacctgcagaaccataaaccaaaataaagctcttttctttatcaatt

SEQ ID NO: 5112 - DNA, 2352 bp, Homo sapiens
  ENST00000477281
aaaatctggcgccctgtggagatctttagactggtcagcaaatatcaaaacgagatctcagacaggagaatctgtgcctctgcatcagcagccgaccttgcctaccagctcctgggtgtcctggagtctttgaggagcaacgatttgaactatttcttctacttcacccacattgatgcaggcatgttcggcgtctttaacaacgggcatctgttcatccgggatgccagtgcagtgggcgtcatcgacaagcaggaaggcagccaagaagccaacagggcaggagagaataaagacatttttagctgcctggtttccggctgccaggcccagctgccctcctgcgaaagcatctctgagaagcagagcctggtgctggtgtgtcagaagttgctgcctcgacttctccaggggaggttcccctccccagtgcaagacgacatagactccatccttgttcagtgtggggacagcatccgcccagacccagaagtccttggggccgccagccagctgaaagacatcttgaggcccctgagaacgtgtgactccagatttgcctatcgttacccagattgcaaatataacgataagttctgaagggctggtgtctagctggccttggggacaacacgcttggctctccattctcccagtcgggttgctgcaaggtagaaagaagcagctcttttttaaagatgagaagaaaggcacactcatttcttagggactgagaggggagttgtgagataccacgtggctgtctctgctggctgggacgtcctggcaaagcccgcggtgggcatcagaagacctgggtgtggacgctcactcaatgtctttgagcctcagtttcctctgttctccaccagactctcctgagggtgaaagaagacacagatggagccaccactgagcatatatcccaagcatgggtcttgggacacatgctcaccacctccatcccaggtggttacaaagtgtgttctggaaaagcacagaggcggggagcatgagaaagagctgctcaggtcaggaggctggagtggagggaaggcaggggaaggacaggctccctgccactaccactttagactcggacaagaggggcccccttcctgctccctatggccctgcgtcactccccacaccatcgcgggatgaggagactgcaggccaaggggacatgcctgccaccacctagagcctggtacctgaggctccatacacctgcgcatggggcttctcgtggtgtgggaagaagccaggggtaagaagataaaggggggccggcgggggaccaatgtgttagcccaagtcttccaagaatatgtgtcaagatagagtgaatggaacaaagatttgttaggggaaatgattgtgtgtaaggaaagaaggagggagccggagaagattgggaggaccagtaagtcgagctgcaagctgagccccggtgaaggagagaatgtctggcaggagcttgctaagctcaaaatcaaagaaaggttcagcaaggctgtcagggtgtcctcaagacaaaggcagccatcagaagagccccgtgtctcccacaaatagaccccgttagcatccctgctgcactcagtggttggcggaaacagcaaagatagatttcagagcacagcagcaggggtccctggtcagccccgctccctagagcaggagatcttgagtgggagaacattcttgttgtagccacagctgaggccctggaccagctctctccacaccgcatgctccgagttgggactctaaggagtctaggaattttcattcaaacttggccttacaggtcactcatcagaaaaatacttttttcaaggtcaaccaatagaacatactttattcaacagtttgttagtttgctttttaaatatttagccacatggtatgtaggcttccatgtacactcttgccctggcccctgaaacataagcagggggctcttctgtacatttgcccagcttccctgccagcctttaaccccaggaacctctcagtctacctcctcttttctgcctctgaatccctacctttaaagtcagaacaggccaggcccggtggctcacgcctgtaatcccagcactttgggaggctgaggtgggtggatcacttgacatcagtagttcaagaccagcctggccaacatggtgaaaccccatccttactaaaaatacaaaaattagccaggtgtggtggcgggcacctgtaatcccagctactcaggaggctgaggcaggagaatcacttgaacccaggaggcagagtttgcagtcagccaagatcacgccactgtactccagcctggatgacacagcgagactccgtctc

SEQ ID NO: 5113 - DNA, 2513 bp, Homo sapiens
  ENST00000377934
ctctttggccaagccctgcctctgtacagcctcgagtggacagccagaggctgcagctggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggagaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctgagataacaccagtgaaaaagcctggcatggagcccagcactgagaacttccagaaagtgttagccttctcccaactgtgttataccaaccacattttcaaatagtaatcattaaagaggcttctgcatcaaaccttcacatgcagctcccatgccaccctccagaattcaccaacacacaggcccaccagcaacaggctacctttgcacaatattctctgatgacaactccaaagccccggctctttccaccacactgtggtcccctagatggggctgttgctgagcccaccccaatccagatgtgatccccctgtgatctacttctggcaagattctcagtctggacaggtcttccctatgagatagaacctgataaggagctagggcaattctgacaacattaccaaaggcccacataacttctaaattttggtctggtctgaaggaaaacctgttcttgccctagtgatggatgaactctcttatctctggcttctagagggaaaaaaaagcatacctcttttactttttaagtacctccatcagagtcatgaaatcacctgtcaagactatctatcttttatgtttccattctggtaagaactctttaaatgaggacactgctgattgctggtgatgttttttgagcaaacactcgggggtatggatgaaagccaatcgcaggtcaaatgactccttggggaagctacttctcctctattcagatttcactaaaatcttccaagatgaaagcaaatctagatttcggtcttcattgctgtccatttttgtaatgaacgagtgtttttcctttagctagtgtatcaggcagggttctaccagagaaacagaaccagtaggagatacatatacatgtccagatttatttcaaagaattgatttacatgattgtggggattggcaagtccaaaatccatatggtaggcctgcaatctgtaaacctttgggcaggagctgatgctgtagtttgcagatagaattccttgttccttaaaaaaatctgtttttgttcttaagggctttgaatgattggatcaggcccacccagattacctagataatctcttttacttaaagtaaactgattgtaggtgctaatcacatctatgaaatgccttcacagcaacacctagattagcattcaattgaataactggggaatacagcctagccaagttgacacataaaattaaccatcacagcaacatgcctgctaaattttatcgaccgtcttcagactgttaaggattgtggtagagaactgtgacagccactctcagcatcaccctgaaccaaaggcccctatcaagtaacaatatagccaagcaaaattccagtcaatagagacattgactggttggctggcttcccaagggatagcaccagacaagaaatgcaaggatgaggaaaccaggcacgggagagagaggggcaacagaggtccagggtttggttatctttttatttttcactgggaggtggtaagttagccctgttgcccatgtatgcagatgggagaagtgatttagaaactccaaagcaattggtaatccccaaaatgggtgtatctggtttgaaatgaaaccttattttattggaaatggttggtttcccaattctgtttgccattggccaatataattgtgggtttgcacatggccagcacatgccaaacagaagtagacaaaggtctcactctgtaagtgggaccttggggaggagctgcctccatcataaagggaggggttagtaaaaatggtctcttaagcctgttcctgctacagttatagaggttgctcagaaccttctcagcaaatatagcagttatctattgttgtgtattaaaccatttcaacacatagtggcttaaaa

SEQ ID NO: 5114 - DNA, 244 bp, Homo sapiens
  ENST00000492138
ggagaatctgtgcctctgcatcagccccaaagacctgcagcattgagcgtgtcctgcggaaaacagagaggttccagaaatggctgcaggccaagcgcctcacgccggacctggtgcagtgacgattcgagaaagttcctagctgcgacctctggcctgaagatctgacaggatgacccttgccagtccacccctctgccagggctcaactcacctgcatcattctctgacagctctttgccag

SEQ ID NO: 5115 - DNA, 5565 bp, Homo sapiens
  ENST00000394767
gcacacagcgactggagacggacggagagcaacgcgctgggagaggagagaccaccgacaacagacccgcgctctcacacatacactcacactcgactctttcctctccccccacctcctcctccttccacccccaccactaacaccatctcctcctccttctctctgcaacaagaaaaaaaagccatttacagttgtaacagttggaggataatgcaaaggaagacgctgcctgggaattcaccgtctgtggaaatgagccccagagaggaataaagcagccctcaccttgctctccccacccgaacccactttccccacccgcctcggcccccaccccaacaccaccatcactcccttccctcccccccacctttcccccttttccacccaggtgtcggaccaggcggtccccacttccaccctgcaccccttcttccccccctgcaccatgaacaccaatgtctgcgtggagcccgggccgagcccggaggccccgggcttgcccaaggaaagccacttgcccgagggggctctgaacagccttgtggattacaactcggaaatggagcgctaccgctcctttgccacctccttctacaagaccaacgggggcgccttcccacaggcggccaagatcgcgcgcatcaccacccccatcttccccagcagcgccgccgccgccgcggccgccgcgcgcatcggcatgtccccctggaactgcgacaacgcggccaccgccgccgccgccaccgccatgctctggggcagcggcgggggcgggggcggcggcggggggggtggcggcggcggcggcggcggcggaggcgggggcgggggtggtgggggcggcaggaaatcctcctccgccgccgcctcctcctccgcctcctcctcctcggcgatcctccccgccggcggtggcggcggcggcggcggcggcggcagcaggaccagcatgcaccaccgaaacgactcccagaggctggggaaagctggctgcccgccagagccgtcgttgcaaatggcaaatactaatttcctctccaccttatcccctgaacactgcagacctttggcgggggaatgcatgaacaagctcaaatgcggcgctgctgaagcagagataatgaatctccccgagcgcgtggggactttttccgctatcccggctttagggggcatctcattacctccaggggtcatcgtcatgacagcccttcactcccccgcagcagcctcagcagccgtcacagacagtgcgtttcaaattgccaatctggcagactgcccgcagaatcattcctcctcctcctcgtcctcctcagggggagctggcggagccaacccagccaagaagaagaggaaaaggtgtggggtctgcgtgccctgcaagaggctcatcaactgtggcgtctgcagcagttgcaggaaccgcaaaacgggacaccagatctgcaaatttagaaaatgtgaagagctaaagaaaaaacctggcacttcactagagagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttatgtatagggctttcttcaaaaaaaaaaaaaaagaggaaaagaaaagaaaaagacataaaaataatgtgagagcttggagaattggccagtctatttactttcaatacgctgattctttctttgatgtaatttagctatagtagtgaagttgttgtctattttgaaagtggctgtaaaaaataagtttgggtaaacccctgctgtaaaatcatgtatctttgcaaagtacatatctatacttcattttcaaatatatgtgtttcagtactgtaaactgtacagatagcagcttgtattttgtgtgtttagacacaaggagacaatcatgtctgagcatctatggagattaacagtttgtacacaacagtatggttctgcaagttaaatctggagcaataaattttagctttaactattttttgccagtggtttagaagcagcaacagcactggcaccattttgccatgcatctttccatagagacttgatgccaagttttacaagactaaaagattatgatgcatccaccaattaccttcagttttattgttataagaggggaagatgttatgaaagtttcaattaatcttttgagcactatattagagtagtggttatgcacttgcattgcttacaaacgagctgtacagaagggtatacctcccaaatacttagtgtagttgacttgtcttgggttgcactgtaaggcagagtactcagagtagttggaaaatgcagaatcagttgtataatttttttttataaaaacggtgttttttaggctaaagaataaagtatcatatcttaggaggggaaaatttataactgacattttttccccagcccaatatgggctgtatacgttttattgtttcttaatttttttcttattttttctgtaggaaaaaatcttaataaaaactaccccaatgttttaacttcatgtatgatattaaatgggtagttttaacacttgaatatgttgagggcttctgccttgaggcagggcttgatatatttttaatttacaaagaattaaacatattcataaaagtgaggcattttatctctttttattttcttttctcatagccacccagttggactagtggtcttcccctggtccttcagtaaaatgctccattgctgccatttccattgttgttacttgatgctttcattcctgagaaggcagggctacagtctctggaatttcataaatgcatgacatacccctccccccacaacctacacacaaaggatctaatgcttcatagaacctgtgctaccttttcatgttggagttggttttcttatcacagtcagggttcttaaggccgtcccatcaggacaaatatttaccttccattttatttctgtttgtcccaattataaagactattttcagtttcaggagtagaacagggtttagcaaaaatatgtagagtatcaaagttacctactgcaactttttgttctttgtccactagccaggtgatttaacccactaaatccattagcttgctgaaaaatgttagcaaagtaaatcacgagaagaaagataatttgagaagagaaatggtatggtacaatgaaagaagctgtaaagattaggaaagactagtaagtgaatatttttaaaaatttagttgtagatttcaatgggatacgataggacagaaaagattttttaaaaagcagaaagagtgtttcatggtgaaagtactgggggagggtggacaaagcatgcacacatgccaatttgaaaatcaagtgtgacttacctcacgtagagtatgaatacatggtccacagttatggtcaacaagcgttttcaagaaaaactcatgatgtgttacacccatccatatttagagatgagaattaaatgattacaagctaaaatgtgctgtatactgtattaattttgagatagctttctacttgatgtatatttctttgagggtttctatctagttagaatttcagcttctgctgtgggaccaatgagagctgtatgagtttttttttttttttccttttccattattttattttttgttttttgtttaccaatttgctaattaattacaagtaagtgaaaacttactttcacacttgaatgataagcttgccttgctctttggaaaatgatgattgttattacagaagtgaaacaaacttctattcaggctacagtaggcatacaataacctaaagatctcatagaagtatactgagagtctaaaatacattctagtagtgcatgtcttggtgtgcttttgtttgtttgctttctaaaagaactaatgaatctgtatattgtaaactgtggtgttttacatgtcaattcatttttttaatgaaagaaaatttgttgattactgaaatgagaaagtgtagcttttcattaattctcttatgttttttattcttgatattgttcttttataccacccactttttaatgtttttggttaaactccatttatataatgtaggatgcatataaagttctcattggtgatgttgaagaaagagatgactcttctggcctttctctagttttcttcctcatatgtccctgtactgagaacttctaaagcttatcattataaacctaaggcagtgatttgaaagtttacatttttcatgattttcaaataccaatgaaatgtaacttttaaatattcctcactgtgtgttttatattcactgtcaagaaaattcagaatgtagattgtgtggacagctatacacaacttaataattatatatcagataaactgaataaaaaactttgtaagagtggtctacgcacacaggatcttgtcctccctaggcgtggatagagagatgccataatctgccagcatttggggagatcatggtaaatacttgaggcgttgatacatagtgcagtgagccaatttccttttcagttgtcactcagcaccataacatcacgaagaacatcattaatgcaaacctctcactaagccttcagaccaaagtggctttctgatggactctgcctgtctgtctacaagtggagtcagattcaaagtagaaatgtatccatccttgggaaagaaaataggaagtcttcccccactgtaggagtatataaaaatgtctcctggttgcttaattcccaacactcaatttccttcttctaaacacatttataaggagcaagagatggtgcacttattatgaattaatattaagcaatcactaaaagaaaggaatattctcttcctttcaatcagaaaccctgatatgtaagttgtgcaattaatgctaaagcatataaagtctttaagctgataagtatctgtaatcaaataatgaaaaaaggaaagcagttaaatgaacacactattcagggtcaaatatgttcagcaaaaagccgtagcgggtctttgatcatggttagattcacagtgatatcaaacagttggttctcatgtaacagctaaatgtttcagtttttttttttttattaaatttggcatttcacactgagatctgtattcctagtgaataaaagacagctactatattaggagggattccattttcacaattgcaaaacagatatttcaggaacatgggccacaaaatgtactcctttcacagtgttctcctcttctgaactgtgcagttatctattaaattttctaatagatatttgtgtaaggtgtatgtatgcttgtgcaattatttaaaaaacggttttggaaaacagtgtatttattaaagaaaattacttatggggcatgtacaaaactgtaaaaaaaaaaaaaaagtaaaaaaaatcacattcaatttgcccagtaaagttgtttttgtgaaatttctgtgttgttgaataaaggactttagtactc

SEQ ID NO: 5116 - DNA, 3130 bp, Homo sapiens
  ENST00000466963
ctccctcgcacacagcgactggagacggacggagagcaacgcgctgggagaggagagaccaccgacaacagacccgcgctctcacacatacactcacactcgactctttcctctccccccacctcctcctccttccacccccaccactaacaccatctcctcctccttctctctgcaacaagaaaaaaaagccatttacagggggtgatgtgcaactaattaaaggcagactggcagcgtctgcaaattctaaggctccccaaataaaaagagactgagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttatgtatagggctttcttcaaaaaaaaaaaaaaagaggaaaagaaaagaaaaagacataaaaataatgtgagagcttggagaattggccagtctatttactttcaatacgctgattctttctttgatgtaatttagctatagtagtgaagttgttgtctattttgaaagtggctgtaaaaaataagtttgggtaaacccctgctgtaaaatcatgtatctttgcaaagtacatatctatacttcattttcaaatatatgtgtttcagtactgtaaactgtacagatagcagcttgtattttgtgtgtttagacacaaggagacaatcatgtctgagcatctatggagattaacagtttgtacacaacagtatggttctgcaagttaaatctggagcaataaattttagctttaactattttttgccagtggtttagaagcagcaacagcactggcaccattttgccatgcatctttccatagagacttgatgccaagttttacaagactaaaagattatgatgcatccaccaattaccttcagttttattgttataagaggggaagatgttatgaaagtttcaattaatcttttgagcactatattagagtagtggttatgcacttgcattgcttacaaacgagctgtacagaagggtatacctcccaaatacttagtgtagttgacttgtcttgggttgcactgtaaggcagagtactcagagtagttggaaaatgcagaatcagttgtataatttttttttataaaaacggtgttttttaggctaaagaataaagtatcatatcttaggaggggaaaatttataactgacattttttccccagcccaatatgggctgtatacgttttattgtttcttaatttttttcttattttttctgtaggaaaaaatcttaataaaaactaccccaatgttttaacttcatgtatgatattaaatgggtagttttaacacttgaatatgttgagggcttctgccttgaggcagggcttgatatatttttaatttacaaagaattaaacatattcataaaagtgaggcattttatctctttttattttcttttctcatagccacccagttggactagtggtcttcccctggtccttcagtaaaatgctccattgctgccatttccattgttgttacttgatgctttcattcctgagaaggcagggctacagtctctggaatttcataaatgcatgacatacccctccccccacaacctacacacaaaggatctaatgcttcatagaacctgtgctaccttttcatgttggagttggttttcttatcacagtcagggttcttaaggccgtcccatcaggacaaatatttaccttccattttatttctgtttgtcccaattataaagactattttcagtttcaggagtagaacagggtttagcaaaaatatgtagagtatcaaagttacctactgcaactttttgttctttgtccactagccaggtgatttaacccactaaatccattagcttgctgaaaaatgttagcaaagtaaatcacgagaagaaagataatttgagaagagaaatggtatggtacaatgaaagaagctgtaaagattaggaaagactagtaagtgaatatttttaaaaatttagttgtagatttcaatgggatacgataggacagaaaagattttttaaaaagcagaaagagtgtttcatggtgaaagtactgggggagggtggacaaagcatgcacacatgccaatttgaaaatcaagtgtgacttacctcacgtagagtatgaatacatggtccacagttatggtcaacaagcgttttcaagaaaaactcatgatgtgttacacccatccatatttagagatgagaattaaatgattacaagctaaaatgtgctgtatactgtattaattttgagatagctttctacttgatgtatatttctttgagggtttctatctagttagaatttcagcttctgctgtgggaccaatgagagctgtatgagtttttttttttttttccttttccattattttattttttgttttttgtttaccaatttgctaattaattacaagtaagtgaaaacttactttcacacttgaatgataagcttgccttgctctttggaaaatgatgattgttattacagaagtgaaacaaacttctattcaggctacagtaggcatacaataacctaaagatctcatagaagtatactgagagtctaaaatacattctagtagtgcatgtcttggtgtgcttttgtttgtttgctttctaaaagaactaatgaatctgtatattgtaaactgtggtgttttacatgtcaattcatttttttaatgaaagaaaatttgttgattactgaaatgagaaagtgtagcttttcattaattctcttatgttttttattcttgatattgttcttttataccacccactttttaatgtttttggttaaactccatttatataatgtaggatgcatataaagttctcattggtgatgttgaagaaagagatgactcttctggcctttctctagttttcttcctcatatgtccctgtactgagaacttctaaagcttatcattataaacctaaggcagtgatttgaaagtttacatttttcatgattttcaaataccaatgaaatgtaacttttaaatat

SEQ ID NO: 5117 - DNA, 363 bp, Homo sapiens
  ENST00000515509
taggcttcttgacctcaaggatcttaatataaggaagaaataatttttaaaagaggcttccctgcttaccttctcacttctcctgcaataaactgtccatattcttacatctggggatgcatactggtctcaatgtatgcatagtaaaatcacgatgcacagtaatatcaaagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttatgtatagggctttcttcaaaaaaaaaaaaa

SEQ ID NO: 5118 - DNA, 3283 bp, Homo sapiens
  ENST00000340533
gcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaccgtgtttgcctgtttggtgtataattgtctttaatgtttagaatctggttatttagaggattccttcaatgtgttactcatccagacccacagaggccatatgactggaggtgcgggaaataggtttgagtgtctcctttcacatcgtcacatctcattgagtaaccatgtattgtatgcttccgatatagtttctttttttcaaggaaattaagaaaggccagaaattatagtttaaggatttctaataattgtcctacttgaaatagatcttaaaaagaaagtagcggctgggcatcgtggctcacacctgtaagcccagcactttgggaggctgaggtgggtggatcacttgaggtcaggagttcaagaccagcctgaccaacatggtgaaaccctgtctctactaaaaatacaaaattagcagggcgtagtggcgcatgcctgtaatcccggctacttgggaggctgaggcaggagaattgcttgaacccaggaggcagaggttgtagtgagctgagatcgcgccgttgaactccagctgggcaacaagagtgaaactctgtctcaaaaaaaaaagaaagtagcctacagggcctataagagagacttcttatcttcactgattgaaaaacatcagcaacttaaaaacacatgaaccatgagagggcatcgcaactgtccattctctcagcttacacgtatcattgcaaaggcactcacagcttcataggttctaaagttttaagaattcctcattcagagagtagaattgtttgtaaactcttctaaggaaaggctggttttctaatttgtaaggagattgtgggacattggaatctgatctttgaagaaatttagcggctagtgtcaagctctgaagagttctggtgtggctctgtctcctcctgggggctctaaggggctgattcagtcatcttacttcccatttattattctctgccttatgtgttattcttttaaatgtggaaacttgaaagctgaatttgttagaacccagtacatgtgtcattggctgtgactgcatttgcactggcatgagctgacaaaccacgaggttcttcagaagtgaccgcgtgcagtggaaaggaattgtgttgttcttacagagtacaacctttataatcaaataggatgcaccgcctttgccttctttagtcactgaaagttgacaagtagtttctatttcaaaataaattacaacacttgttaagggacctatgtaaatatttcaatatttttggttgtgatttttagctataaagcttcacattttagtagtttttaaaacattgctcctaaatcaactatgaagtgaatcgaagtgggtcagtcgtaccttagatgacattaaagggttaacttgtaaatcatttttaagatgttgagtaatagcatctgtatatcgttaagaaacataacagttgaactttgacatttttatcagtgactcagcaatttgctgctgtggctggcaatgtttcttcatgtgttttgggaacaacatgtggagtaaaggagagtttacttcctaattttaacatttacagtttgtgcagccagactctcaaggaaagatatttgacacttttttctctattgctttcccttcagagaggtgagagacttcagaggctgccctttcttttcatctgctgcttgtgaaaggaaaacatcttgggcccccagaatcactaaggaaaactcaagctggaaactgcttagggccaacctgcctcccattctactcagtcaagcctctgctcactgagagagaggcatatctgattgcttcctttggaaaggctaatcagaaactcagaagaatgcaaccctttgtgtctcacctctctgtgacctggaagctccctcctgctttgagtcttcctgcctttgcttcaaggtgtcccgcctttccaaacagaaccaatgtacttcttacatatattgatcaatgtctcatgtctccctaaaatgcataaaaccaagctgtgccctgaccaccttgggtacatgtcattaggacctcctgatgctttgtcacgggcatgtcctcaaccttggcaaagtaaactttcttttttttttttttttgtttttgagacagagtctcactctgtcgcccaggctggagtgcagtggtatgatcttggctcactgcaacctccgactcccaggttcaagtgattctcctgccccagcctcctgagtagctgggactacaggcgtatgccaccatgcctagctaatttttttgtatttttagtagagacgggatttcaccatgttagccaggctggtcttgaactcctgacctcaggcaatccacccgcctcaggctcgcaaagtgctggaattacaggcatgagccactgtgccgggcctattccttgactttcttaataaagttgttttcactttgc

SEQ ID NO: 5119 - DNA, 1173 bp, Homo sapiens
  ENST00000580678
tgagttgggaggtttgtttgattttgtttttggtggtaggagatatgtactttgagggagtaagcttcattcatctgacaagtttatttgccccgatattttcatcccatacttcacaaaggcaaagtgtcttagggtcatcagggaggcctgccgttacacatgcctgatcccatccttgtttccagctgtgggtcaggtttcaggccctgactgtggcacttctgcttcacctgcccactgggcttccccctggccagcctttaaacacactgtatttttgacagcttcagcctgaagttgaaatagtttatgactctaaaactgggagactgcagggcttaactgaagatatcatacacgtaagagatacatgcacaatctcaaatggaatttgagaggacagaagggaagaatcagtcttcagctcctccctgaattacgtgtcgcaatctgagtctaataaatgtgtgtgcacatcagcatgtacagagagctgtcatgggtgctgttcgaaactttggaactctagatagaaaatatctcttggcacttaatctgctactaatttttgctgttaaatcagatggatcaaactttgtgtttaatagctaaatgttgaatctgaaatggtaattactgaattataattttaaaaagtctcaaagtcagcattttggaagtggtactttcatagatttttaaattccataatgtgccttatcttttcattgcaggatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtat

SEQ ID NO: 5120 - DNA, 718 bp, Homo sapiens
  ENST00000299438
ggctcggtgttaattaaccttttccagtcacgccttggcagccaggtgccgtgcttgactcctgagaccgcggtgtgtggctggagcaagaacacagaggccaggcagagcagcggacgttctgcgtgggactcgcccctaacagctttggaagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 5121 - DNA, 776 bp, Homo sapiens
  ENST00000494131
gcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 5122 - DNA, 5913 bp, Homo sapiens
  ENST00000583418
cccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggtaagtgtgaccatctcaagtatctctggatgttctcgttgtatttaatacttgtcaaactgaaggcagagggtttttatttacctgactgatgccagcacaggtctttctagataaatgaatatgtaacctactggctcagcaagtattttttatttacggaaacctgtcagtatgatttgttaggatggcgtgtgtgtaatttttttaaggctgtcagtaaactacttttttcatcataattatcaatatataccatttgaagagctactttttatggtagcacgtgcttctgatctaaaagatttgacacaagccttattttcagagaacttaaaatctgaatggatagtggttttattacttaaatctttaagggtgtgtctcatgtcttcttcatctttaagtctcttgggcatagtaggtgttcaataaatacttgtcagatgaatttaatgaaattaaataatacccttttgacttacttttccttgggaaaggaaaataactctggcaatactagttttatgttctgattcactagcctttctctctgaactgaccatctcacttatatttgaagataaatgtagggtgagaatggaagagcacagcctaagttcctgaaaagtacaagtaggcaaaatagtttctagtgtctaattaaaggactacaggggaaagttttgcttaaatcaaatgacaaaaaagaaagtataatttttcgttttggtgtaaattcttggtttcattagagaaagtgcaacagcaagaccccactgagcttgtgtcgagaactggtgagctgattttttgagctgttgctgccaagacatcatctttaatctacaaaaggatcaaagcagttaatccaataatataagcataaaggccacatttacctcaacatccctgatagtacaataaaagtcttgtgtaatactatttagtacaaagcaattttttttatattctctccttattcaagaaagacttaagttcaatgtgaatgatatgagtacttccaggagataaaaagttgacttcagaatttcaatggcctctgtgacaattgcttagaatccttgctgtgagttcatttgactttagcatcttttttgaggctactttttggacagctgaaattctgtgttgcataaagtttttcctttttctctgaagtctcttaagggaagaatatatattttttttatcatgtgttcagcatgttaatcattttggtataagtcatttagctatagcaaaacaaaggtttaagattcattagatgaacttagatgaccgcagggccagccgtctcgctaaccataaagactacaagcagaaaacacttgtaggtgtaagattgtacatgtgtctcctgccataactactttcagtttaaaggacaaagactttcttccttatttgcttttagaacacgtgtattacagcctatactctgttggattaattgcccattactatttattgttcttattttctattttaaagtggcagttactttgatactgagaatattttgggaacagagcaagtttatgtggtaaattctgggactttagcttttagtatcaaagaaagctttcctgacaacattgaggcacagccctttgtgcgttaagacatggcttacttcattccagcattagcagttgatacttgatcagcttgttagatgtagaaggtctcactgaagtttgagaatcacactaactttttaaagtagatttttgtttgtttgtttttgagacggaattttgctcttgtcacccaggctggagtgcaatggcgtgatctcggctcactgcaacatccacctgctgggttcaagcaattctcctgcctcagcctcccgagtagctgggattacaggtgcctgccaccatgcccagctaatttttgtatttttagtagagatggggtttcaccattgttggccaggcttgtcttgaactcctgacctcaggcattcgcctgcttcagcctcccaaaatgccgagattacaggtgtgagccacggcacccagcctaaagtagatgtttttactctcttcagagattttacagattaactaacttctgagtattttttaaacaactcttctttattgtgactttgcttcagtgagagcagaaccggaagaatgtgggacaagaacttgctggcctttttgagaggccataagcagatgaaatgaaaggaaatacatgagcatttttctggatgtatctttcttgtgcttttggtttagtggaagtaaagagtgtccttagggatttcttttgtcatgtgtctgtataaccatcggccgatctccaggttgaagaatgtacactgtggtctaaagttttgagatgttgcctgcttaaaatatctagttgaatagtgaaataaaatgcagtaaagattattagcttgaacctgccctaaggaaagcatagtgttaagttaccaaattaagatatttgtagacttagaaatcatgcattttaatctaacataaatgtttctatcacatttgcttacatagagaatattagtcgtagcaataccccttcttggttatagttttgaaagcattcttgtagaagttatttggtcctcacagtgtctccatgttagacctgccaagggaggtaggtacattgcagctgggaagtgttaagcacccggctcacagacgtgctccagaaccatctagcacccatctcaggctggtcagttgcagtcccttaagcttctcctctaggttctgggcttgccgtgttagacatcactctgtcagtattttaagggagataggcttcccactaaagtttacgttagatgaacttataaatgagatgactctgattcacaaaagcttgttgggctttgcatgcttttcataatttatggagcttactgtaatttacactgattcacatgacttttataagtcattatgcatgacatacttattttacttttttgagacggggtctcactctgttgcccaggctgcaatgcagcggcatggatctggactcactgcaccatccacctcccggggtcaagcaatcctcccacctcagcctcccgagtagctggaccataggcacacagcactgtgcccagctaatttttgtatttttctgtagagacagggtttcaccatgttgcccagactggtctcgaactgctggactcaagcaacccgccaatctcggcctcccaaagtgctgggattacaggcctgagccaccatgcccagactttgacacactgatttaattgttaacctctttttactgaagttgaacctcgaagtcatggagtgaacaggtggcagagccaatcataaaaaccatattctttctccttgttcattgctgacattctttgatagtcacgtccctaaacccaagtgaggccctcagagcactgaccactaaagaccaattacttttccatcaaagtgcaaagtggtaattcaaacttcctttaactgtcaagcatcctgggctacagagccaagaagataatcaacaatcaaaaggtgatacgattatttcaagttcccctctttagagttcatggctgttgctgatgatgctggtgccagagtagtgttttaaccttagcgctctcccatggtaaccacaaaggcagcaggagggcaggtgggaggttccagagttgtcagcacgttggtgaaatgcctgccctcattttaacgacgccgtggatgtttgtgtttgccttccgttggctgtttcaaacttaactttctagtttgacaatcatattttaccttcagtgattcttttgtttcagaactgattgtgtcctctaatagctaactaatatttttgtatattttgattatttctagtaatttttgttaattttattcatatatacacaatttggaaaatcctcttgctgtagttatgaatactttttatagatgctaagattttaaaattgctggaatagataataaatttgcaattttatttttaaatgacttaccttttttcccctactgtgtcaggaaccttaaaggcggtgtttcaaggttggtgggtctcataactgctttgcttgcttttccctgaaaggggtctgtcttttcacgggagtttctctaacgtgctttgcagagtgatgcttgccttactgcaggccgctgattgttttgctaatgctttttatctttgctttgggaaactgcagatctgaagctgtcttatttatggcaacttctgtttgaggccctaatgcttatgttggtgtggaacatcaaaagaatgcttcttaacccattttcaagccccaaaaagttgatatttcactagaccttagcttttcagctgttggagaagtatgcgtttttccagaaccattgtccattcactttagtgctactcaaaagagctgctcccagaaagctctggaggataaaaacagggcttccttatctggggatttgctgttaggctgacagtgaccagctggtgacaagtgtgacgccgggcacagcagtcctgtgaggctggtctggtgtcttgctggttccgtctggtcagaattaaagcagccccccgggaaagttggcctagaatgtagaacttaaaatggcagtcctcttttttctttttggttcacatatatttaatgtaatttaggtacacttttttacatctgtcagatttgaatgaaataactgatgtttttattgaacattgtgttcatgcttttgaagaattaaactgctttttctaaaggtgacgtgggattgtgtgtatgtgaacatgaatgtctgttttcagtttctgcattatttagatgcctagcgtgtgcaagatattttatgtagcatattaattttgaatgtttttaaattattgaggttatgtccttaagtaaatataatgattaaaatgttttactctggaagaaaacaaagttaggcattttagtgaaaagaagtttataattttccctttcgacatcttctgaagaatgcattgcataaaatattgtgttcttattttcaaacaggattttagtcaatgaaataagttcagcattcccttgaacttactttactttttcctctcgtgtttcaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 5123 - DNA, 619 bp, Homo sapiens
  ENST00000397914
ccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaac

SEQ ID NO: 5124 - DNA, 305 bp, Homo sapiens
  ENST00000579064
ggtgctgttcgaaactttggaactctagatagaaaatatctcttggcacttaatctgctactaatttttgctgttaaatcagatggatcaaactttgtgtttaatagctaaatgttgaatctgaaatggatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagag

SEQ ID NO: 5125 - DNA, 4098 bp, Homo sapiens
  ENST00000305786
gtagccgccagctcggccgcacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatgactttttgactgtgcttgatttcatgactgatgcacaaattttaatgattaaaaagtgcaggagccctaaatgtcagtgcagcagccctaaatgtcagtgcagcagtgttaaccagtcatggtgctagattgtttacttggttttctaggactgcctcaactagaataacacttcactaattgactcttagtttctttgctcagattgagaactgcagcatttatgccagacatggacagaggaatgcctgtggtcatagttttgtgatgtgtaacagtgtataattacatactgaattatttcatgcatagtctgtgccatacacatttagagtagtccttggagattttatggagatggtgagcacaaggtaagtcataaagaataatgagaaaataaatctatgctggtgcagctgagaactgtatctttgtgggacagtgagaagactgagaagatgtgaatccatggtctcaaaggtgatagggacgattagataggtgttttaaggcctgaaagcaatttataacatatgagtcttatttttatttatagaaatgtggaaagcttgctgtaattcatatttgaagtcctagtctgagttctggtggggaatttaaaaatgcatcctggaaatcctttaaagatttcagactttgaaaggccttgtagcagaggacttggtgactgtataaagttagtggtattcagggacagtgtagcaagtagcttacaaggggacaattctggactaatgagaaagacctgaagtgaaggctagagagttgattttttttttttttggcatcctggaaatgatacaggaaacatattaagatagatacagaaatgtgttcaaccttccatcttggctagttgtggcgtttagtttgttttttgagacatggtcacgctgtgtcgccaaggctggagtgcagtggtgcgatctcggctggctgcaacctctatttcccaggctcaagcgattctctcacttcagcttcccaagtagctgggactacaggtgttcgccaccatgcccagctaatttttttgtagagatggagttttgccatgtggtcccaggctggtctcaaactcctgagctcaagcaatccgtccacttgccttggctccccaaagtgctgggattacaggcgtgagccaccaggccctgcctggttttcaaattcagaaatcttattatttaacccagaagtaatcagcccagtagtaacttaggtttaattttttttcaggtttaaaatttttctcatttattttttctgagacggagtttcgcccttttcgcccaggctgagtacagtggtgcaatctcactgcaacctccgccttccagttgcaagtgattctcctgcctcagcctcctgagtagctgggattacaggcacccgccaccacgcctggctaatttttgtatttttagtggagatggtgtttcaccatgttggccagactggtcttggactcctgacctcgtgatccacccaccttggcctcccaaagttctaggattacaggtgtgagccaccacgtccggccaatttttctcatttctatgcctcctatattaaggtctgtgttggcacagatgagtaactgccatgttctaggtcagttatacccaagcacttctggtggtttaaaatgtgattctgtaacttttttatttttatttttttgagataatttcactcttgttgcccaggctggagtgcaatggcgtgatcgctgctcaccgcaacctccgccttccaggttcaagcgattctcctgactcagcctctcaagtagctgggattacaagcatgcgccaccatgcccagcttattttgtgtttttagtagagacagggtttctccatgctggacaggctggtcttgaactcccgacgtcaggtgatctacctgcctcggcctcccaaagtgctgggattacaggcgtgagccaccacgcctggccaattatgtaattttttaaaaaggacatttctatcagggatatataccttcagaaataaggaaataggggaaaaaaagagcactataaaccacatgttttcatttctagtgcttcgctgtaagtggctaggttggtagaatcaaaaacaagggccagatgtatttaaggggtattcagatgccacctacatgcttattttgtctagaacagtgctgtctaatagaactttctgtgacgatggatattttgtagacttttgctgtccagtgtggtagccactaaccacatgtggctgttaagcccttgaaatatagctagtgtgactagaaagtattttattttaaatttacataggcacaagtggctagtggctactgtattgacattctgggtctaggactagaaccagtggtctgtaacaaaagtactttctctttactctattaaatctagaattagccgggcatggtcgctcatgcctgtaatcccagcactttgggaggccaaggcaggcagatcacttgaggtcaggcgtttgagaccagcctggtcaacatggcgaaaccctgtctctacaaaaaacataaaaattagccaggtgtggtggtgggcacctgtaatctcagctacttgggaggctgaggcacaagaatcacttgaacttgggaggtggaggttgcagtgagccaagattgtgccactgcactcaagcctgggtgacgagtgaaactgtctccaaaaaaaaaaaaaaa

SEQ ID NO: 5126 - DNA, 974 bp, Homo sapiens
  ENST00000409409
acgtccggcttcggagcgggagtgttcgttgtgccagcgactaaaaagaggtgagagcgggtcgcggaggccgcacctggttagaggcagagctgtgggaggcgcgcacttgcgagcgaccgaaacccaagcggggagcattcgagtggagcccgcgctgggtgggagggcggggagtgaagaccctggactgtggtcagaccgagctgggcgagtaacggcttgaggtgcggcggagccctaactagggacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaac

SEQ ID NO: 5127 - DNA, 799 bp, Homo sapiens
  ENST00000409764
agagagtggggacgtccggcttcggagcgggagtgttcgttgtgccagcgactaaaaagagagggcaaaagctgttgctcttctaataaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgt

SEQ ID NO: 5128 - DNA, 498 bp, Homo sapiens
  ENST00000413447
agagagtggggacgtccggcttcggagcgggagtgttcgttgtgccagcgactaaaaagaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaa

SEQ ID NO: 5129 - DNA, 4210 bp, Homo sapiens
  ENST00000616178
agcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacaggcctgccagtggtccccgagggctttgtttcaccccactggtggcacacagggccgaagaggctgccgatccctgctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagg

SEQ ID NO: 5130 - DNA, 4124 bp, Homo sapiens
  ENST00000620254
cggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaa

SEQ ID NO: 5131 - DNA, 3477 bp, Homo sapiens
  ENST00000522463
agagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatg

SEQ ID NO: 5132 - DNA, 3673 bp, Homo sapiens
  ENST00000435847
agagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaa

SEQ ID NO: 5133 - DNA, 580 bp, Homo sapiens
  ENST00000522637
atcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatg

SEQ ID NO: 5134 - DNA, 6370 bp, Homo sapiens
  ENST00000521420
atcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccag

SEQ ID NO: 5135 - DNA, 1294 bp, Homo sapiens
  ENST00000622696
ccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtaaaactcccctgaggccgcacccatggagcctgggcttaccctctcaccttcttcttattaaaaatccgttttaaaaaacaatgtttcttttttcttaaacattgatacagatcttacggcacataatggtttgtaacctgttcctttcctgtaatataatataccgtagtcacctttccagatgtcattaaggctatttctacaatgttatgtgtaatgactgccaagtattctgttgtattggaacattgtcatgtaacatatcccctgtggttggatatttgtttgctaaacttcattgaacacccttgtagcagtttttgtgcacatctttttgtcaaggcaaacttcctagaagagaaattgctggctcaaagggaaaaacagaataaatctttttttttatttcaata

SEQ ID NO: 5136 - DNA, 967 bp, Homo sapiens
  ENST00000617629
cggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaa

SEQ ID NO: 5137 - DNA, 1000 bp, Homo sapiens
  ENST00000611075
cctggacccgccgcagagccaggtaagcggccctcgcaggcctcgggccgggcacggggactaggatgccgccggggacggggatgaggccgtgaggatgcgcgaagggccgccccctctcccggcccgcggggggcgctcggcgctgtgcccgggctagcccgaggcccggcctcaggccccacgcggcccctttccccctcggacccaccgtgcgtcccgcggcacggaccctctgcccgggaggcgcgggcacatcgcggagctccggcgcggcggcgggggagccgcagcagcaggtgcgcggcctgggccggagccgccagcccgggaggaggcggtgctaatctcagggaccggagacacctgcagcggccgcgagcccggcagcggcgacatcctcgagtccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaa

SEQ ID NO: 5138 - DNA, 925 bp, Homo sapiens
  ENST00000611925
gaggggcgcagcgtcgatgtttgggggcggagggctttgatgagagaggagcaggtctgacccgcttggaagctttctggcctacactagcatcgctcaccaagctggctgcgggcacggtggaagtgggggaaggggatgagtgggctgactcctgggggaaaaggtggtttttttcttgagctctgaagaaccaggaagatgcttgcctgtctgttgtggcgtctacttttcagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccag

SEQ ID NO: 5139 - DNA, 4256 bp, Homo sapiens
  ENST00000618329
gtagagttaaggaagggcctcttcctctgtgagaattcagcattttgcaaccatccaaaaatgttgagggcatgctttgcttccagggcagacagagcagcacagtgagcatgggacacaggatccctgacttgctgtgtgcccttaaaccagccactacctctctgacgttcaaaattgagcaatggaaggcagcctgcccaactgttacctgcctgtcatcatgaaagcctgcggatgagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaa

SEQ ID NO: 5140 - DNA, 377 bp, Homo sapiens
  ENST00000518456
aattcagcattttgcaaccatccaaaaatgttgagggcatgctttgcttccagggcagacagagcagcacagtgagcatgggacacaggatccctgacttgctgtgtgcccttaaaccagccactacctctctgacgttcaaaattgagcaatggaaggcagcctgcccaactgttacctgcctgtcatcatgaaagcctgcggatgagtacacaaaatggacaatgttgacatgctgaacacatcagcccccacagccaaccccccaactctgctccattcctgccactcaagggaagagatgaacatgcaagcaataatatcacacagagatcttgaaccctcgcctcacatacaataaaatgtaccttgtttgc

SEQ ID NO: 5141 - DNA, 915 bp, Homo sapiens
  ENST00000621516
agtctcgcttcgtcacccaggctggagtacagtggctcaatctcagctcactgcaacctccacctcccaggttcaagcaattctgcctcaccctcccgagtagctgggactacagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgatattttagatgcattgtctcatttgctcctgacatcaaccctgtgagaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaac

SEQ ID NO: 5142 - DNA, 409 bp, Homo sapiens
  ENST00000518511
tcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccaggtgagggcagactccttgttaggcctggcctgatgtctcggggttataggcaggcgtgtagaggttgggtggaccacgagcccaagcagacaagctcagtctgcagcttccatctccactgccctacttgagagtgaaatgtagctgaggacttaagtctgtcctcccaaccccaggtggccgattcaccctctccagttgtcatgctcgtgaagccctctcagccagtgctc

SEQ ID NO: 5143 - DNA, 771 bp, Homo sapiens
  ENST00000520942
aaaaaaggcggagggaaggaggaaagagggtggaaagagaaggagagaagggggcgagaggtagagggggtgggtggagggaggggccacccccacgtctcagagtggccctggcttctcccaccacagtgtgcttccatgttgccagggcactgttggaaaagaggcacagtcacattcatatttccgcaatcccagcccaaaggccccccaaagccagcttcaaccgcagagtgtctgtgctgtcagagtgggtaggctggttttggaggttgcccaccttgctttttctgtgctcagattccatccctttgtagtcctagagaggctgtgttcccgcccctctcatattactggtaagtattatggaccaggtatctggaaaggcctacagttggatcctagatgaggctggcaccaaagaggaggaggaaggactgttccattaggcctgaagctcccacagtgttggacttagcaggctttcttgctgaggcggctgggataccatttggtgtcacccaggggagttggccacgtgggctgagcaccaggagcagctaatgcctgttccacccaggcgcctgaggctgggaccctctccgaccccataattttctacccaggtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagc

SEQ ID NO: 5144 - DNA, 576 bp, Homo sapiens
  ENST00000520960
ctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgacggagtcttgctctgttgcccaggttggagtgcagtggcactatctcagctcaccgcaacctccgcttcccaggttcaggctggagtgcagtcgtgtgatctcagctcaccgcaacctctgccacccagaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggc

SEQ ID NO: 5145 - DNA, 745 bp, Homo sapiens
  ENST00000518555
ggaccatatcctggaaaccaaagaaccttccatgatggagtaagaggcaggattgggccagcaagtggctcctggggtacaagtagagggcagtttgccagggagatccgttctttccagaaggaagcactgagttgacaagaaatgaggccatatgtcccaccacagggagagctcagccagacagaatcatttaattcagccttgcagataaattctgaagtttcccagcccaactgcccttcctatgccttgtcagcctcataacagctatgctcagaaaagaatcatctcaggagcaggtagcttgtattcttaactgctacctgatgtgttttagtcccaaatgaatttttacaagtcttggttttatttgcaccctggactttttctttggactgactgtaaagtaagttgcttctaagcggtggaggctcaaggaacgtaagagagggatgaaagatggtcttttcctgactgtgaacttgtttctatttcccaagcaagtataaagctgtcttccttaaggggggttattagcaagcggctggctgtgtttttccctcttcaggtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcag

SEQ ID NO: 5146 - DNA, 579 bp, Homo sapiens
  ENST00000520424
ataaagctgaacgggcaccagtgatgtttcctgcttcctctccaccaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttc

SEQ ID NO: 5147 - DNA, 583 bp, Homo sapiens
  ENST00000522892
gtttcccatagaccctactgagcagtgtcaacttcccactgaccaccccgattcacctcccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcaggtaccaatcttatataataaatgggctctgatcactgacaggaacttgagagcatttgaccaaaccccctcattgtacaggtcaggaaactgaggctcagagaagggaagacaatgtccaatacccaaaaactggttaatattaatagcaacagcaggtctggaatgagatttgctgactctcaggcctgagtgtttcttctgtagcctgtatcatgtatc

SEQ ID NO: 5148 - DNA, 916 bp, Homo sapiens
  ENST00000523383
gtctcattttctgctctgcgactccttttgcagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagg

SEQ ID NO: 5149 - DNA, 562 bp, Homo sapiens
  ENST00000524058
ttttctgctctgcgactccttttgcagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagtgagtaccccccagagaaggcagggttacccccaacctgcctgtgctcctgcaagtcatggggctgccagagttcagccagaaacgtgggcagggggtgggggtggttggccaacaactactttgttgagtgtgttgagctgactgcattggcaagaaagagcccagtaagggtttgatagtaagaccctcactgcctgc

SEQ ID NO: 5150 - DNA, 892 bp, Homo sapiens
  ENST00000519663
cttttgcagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagg

SEQ ID NO: 5151 - DNA, 579 bp, Homo sapiens
  ENST00000522884
gatttcagcaagcttcacattttgggggcaggcaggggaagaattctagaagagaaacagggtattctagtgagacaagccaatgctgactgtttaagagatttaggattgaaatctgcttttgaactcgcattccggcggtcctctttggtgttctcaccaagggcaaaaggactcaaatcctcagcggaggacagaaggtggcctctcttctggcaaaacatgcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagtgagtaccccccagagaaggcagggttacccccaacctgcctgtgctcctgcaagtcatggggctgccagagttcagccagaaacgtgggcagggggtgggggtggttggccaa

SEQ ID NO: 5152 - DNA, 582 bp, Homo sapiens
  ENST00000522775
gatttcagcaagcttcacattttgggggcaggcaggggaagaattctagaagagaaacagggtattctagtgagacaagccaatgctgactgtttaagagatttaggattgaaatctgcttttgaactcgcattccggcggtcctctttggtgttctcaccaagggcaaaaggactcaaatcctcagcggaggacagaaggtggcctctcttctggcaaaacatgcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcag

SEQ ID NO: 5153 - DNA, 2158 bp, Homo sapiens
  ENST00000293230
ggtgggcgggcggcagtcgcgtcgcccccaccccgcgcagccttcaccttgccggcattggctcttacccacacggggctgggggtttggagcggatttgtttttttaaacattttccagcagaccacatccccgccccaccgctggctgtcccccgccccccgcacatataccctgcacacacgcacgcacacacacacacacacccggcgcgcacagacacacgctccctccctccgcgctctacccctcgcccgcccgccgcgcacgcagccggccccggctcccggcgccccgcgccccgcgccccgcgccccgccaccgccgccgccgagcaaagccgggctgggcttggagctgctcatggagaaagtgccaggcgagatggagatcgagcgcagggagcggagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctgta

SEQ ID NO: 5154 - DNA, 842 bp, Homo sapiens
  ENST00000586160
gggtggcccgaggagggacgagacaggccggacagaatgcgccacgtttcagaattaatggaaaaagagctcacattggtatcgtgctttgcagtttgtgaaacacttttttacccagtttatgtcacaagacagacattattcacattttagagaaaaagatccggagctcccatgggccagtagacttgcctgagatcacacagcacgttcgtagcaggacggagactagaacttgggtctcacggttgctttcaactgcactgtgccggatctcttggcaggaacccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtga

SEQ ID NO: 5155 - DNA, 815 bp, Homo sapiens
  ENST00000589342
cccgcccgccgcgcacgcagccggccccggctcccggcgccccgcgccccgcgccccgcgccccgccaccgccgccgccgagcaaagccgggctgggcttggagctgctcatggagaaagtgccaggcgagatggagatcgagcgcagggagcggagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagcccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacagg

SEQ ID NO: 5156 - DNA, 830 bp, Homo sapiens
  ENST00000590175
aggatttaatttcagatcaactcatgattccagaacctgagttcttaccctctcggctatgactagagcagggcttgaagggggtgtagagtttgggaaggaagcaagaagcgaggaagacagaggcctaggagatgaagccgccagcctgagcaagcctggcagatagacatggccagacttggtaggggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggc

SEQ ID NO: 5157 - DNA, 788 bp, Homo sapiens
  ENST00000589145
tgcaaattccagcttgtacttaaatacttcctgcgaagttttgactgagacgctgcaacaattcccgagctgtttcatcgtggcaccttcctggtggcaggtggattagcacattgtctgcaacccaggaggacttggaggaaagtcccagctctgctgattctagctgagtaaccttggcaaaggtcacctcacttctctctgagtcttattttctcatctgtaaaatgaggaggaggaggaggatcatccaaacatcacgggacttcgttaaatcagtgcttcggggcacttagcacagcgcctggcgcaaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaa

SEQ ID NO: 5158 - DNA, 2566 bp, Homo sapiens
  ENST00000494263
gggagaagccgagggcagcttagccacggccggttcccgttccctccaggacgcgagggtcgccttgggtggggaaccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcggtaggacagaatgctgttctggggggcacaggatctctttgtggggagggaatcagaggaggaaatctgaagtgaagacaggtgggctggggctagtgacaaggatgagatgggagaggtaggggagaaggagtggggcactttgtacccccatgaatccagagcagactccagacattcttttccctgcagtctctaccctgtggtccccacaaactcccggatcatagaaaaggaaattgaagttgatggcttcctcttccccaagaacgtgagtggggctagagagcccgattgcccaggagtgccctatgcccccgaagagaggcattcatgctgcccaatcttcctttatagacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttctta

SEQ ID NO: 5159 - DNA, 2286 bp, Homo sapiens
  ENST00000258415
gccgagggcagcttagccacggccggttcccgttccctccaggacgcgagggtcgccttgggtggggaaccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttattgga

SEQ ID NO: 5160 - DNA, 903 bp, Homo sapiens
  ENST00000445971
cccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacagggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccc

SEQ ID NO: 5161 - DNA, 1210 bp, Homo sapiens
  ENST00000466602
gcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacagggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaaggtacccttgctgggagaggggctggggaagggaatgggtcagggagaggttgtgctccctctcctcaagggctcctggattccatatgtcctggttctgcctcctgtgatggcctctgtgcactactcagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttggtgaggactcccagatggggcccagggaagagagatgggggtgactccaggtctgtgcatcagcggtctctcccaggccttttccctcatgctaccagttgtcggagtggctcttggtccttggagatcatgacttttggctttgtcctttcctcttctctgttgctttcacagggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacga

SEQ ID NO: 5162 - DNA, 799 bp, Homo sapiens
  ENST00000411688
catgaaggaagaaggcatggcttagctaaaaggagaaatgtcccagaaacctccatactgacagccaggaagtagtctcagaggctttggattccaggaaagaagctggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactgg

SEQ ID NO: 5163 - DNA, 1187 bp, Homo sapiens
  ENST00000360124
ttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctccctagccagaggctctaatgtacaataaagcaatgtggtagttccaa

SEQ ID NO: 5164 - DNA, 1684 bp, Homo sapiens
  ENST00000360608
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctccctagccagaggctctaatgtacaataaagcaatgtggtagttccaa

SEQ ID NO: 5165 - DNA, 2257 bp, Homo sapiens
  ENST00000488442
cccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggctcccctaccagaagcaaacatggatggtgggtgaaaccacaggctggaccagaagccaggctgagaaggggaagcaggtttgggggacgtcctggagaagggcatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccacgatcaggaggctgggtctcctccttccacctgctcactcctggtagccccgggggtcgtccaaggttcaaataggactaggacctgtagtctggggtgatcctggcttgacaagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctccctagccagag

SEQ ID NO: 5166 - DNA, 1433 bp, Homo sapiens
  ENST00000359033
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccc

SEQ ID NO: 5167 - DNA, 1714 bp, Homo sapiens
  ENST00000389970
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcagggaggaagggtacaggcgggggcccatcccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctccctagccagaggctctaatgtacaataaagcaatgtggtagttcc

SEQ ID NO: 5168 - DNA, 1187 bp, Homo sapiens
  ENST00000625976
ttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 5169 - DNA, 1684 bp, Homo sapiens
  ENST00000615454
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 5170 - DNA, 2257 bp, Homo sapiens
  ENST00000628592
cccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtcctgaggatgccccaccaccagcaaacatgggtggtgggtgaaaccacaggctggaccagaagccaggctgagaaggggaagcaggtttgggggacttcctggagaagggcatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccaggatcaggaggctgggtctcctccttccacctgctcactcctggtagccccgggggtcgtccaaggttcaaataggactaggacctgtagtctggggggatcctggcttgacaagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagag

SEQ ID NO: 5171 - DNA, 1433 bp, Homo sapiens
  ENST00000612990
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccc

SEQ ID NO: 5172 - DNA, 1684 bp, Homo sapiens
  ENST00000607853
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 5173 - DNA, 1504 bp, Homo sapiens
  ENST00000619390
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 5174 - DNA, 1187 bp, Homo sapiens
  ENST00000630793
ttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 5175 - DNA, 1684 bp, Homo sapiens; identical to SEQ ID NO: 5172
  ENST00000630716

SEQ ID NO: 5176 - DNA, 1714 bp, Homo sapiens
  ENST00000625898
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcagggaggaagggtacaggcgggggcccatcccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 5177 - DNA, 2257 bp, Homo sapiens
  ENST00000626412
cccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccaggtgagggaggaggtcctggagggcggcagaggtgctgaggctcccctaccagaagcaaacatggatggtgggtgaaaccacaggctggaccagaagccaggctgagaaggggaagcaggtttgggggacttcctggagaagggcatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccacgatcaggaggctgggtctcctccttccacctgctcactcctggtagccccgggggtcgtccaaggttcaaataggactaggacctgtagtctggggggatcctggcttgacaagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagag

SEQ ID NO: 5178 - DNA, 1433 bp, Homo sapiens
  ENST00000629640
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccc

SEQ ID NO: 5179 - DNA, 1187 bp, Homo sapiens; identical to SEQ ID NO: 5174
  ENST00000635505

SEQ ID NO: 5180 - DNA, 1684 bp, Homo sapiens; identical to SEQ ID NO: 5172
  ENST00000634240

SEQ ID NO: 5181 - DNA, 2257 bp, Homo sapiens; identical to SEQ ID NO: 5177
  ENST00000635201

SEQ ID NO: 5182 - DNA, 1433 bp, Homo sapiens; identical to SEQ ID NO: 5178
  ENST00000634653

SEQ ID NO: 5183 - DNA, 1714 bp, Homo sapiens; identical to SEQ ID NO: 5176
  ENST00000635028

SEQ ID NO: 5184 - DNA, 1187 bp, Homo sapiens
  ENST00000636910
ttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 5185 - DNA, 1684 bp, Homo sapiens
  ENST00000638004
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 5186 - DNA, 1714 bp, Homo sapiens
  ENST00000636361
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcagggaggaagggtacaggcgggggcccatcccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 5187 - DNA, 2257 bp, Homo sapiens
  ENST00000635910
cccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccaggtgagggaggaggtcctggagggcggcagaggtgctgaggctcccctaccagaagcaaacatggatggtgggtgaaaccacaggctggaccagaagccaggctgagaaggggaagcaggtttgggggacttcctggagaagggcatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccaggatcaggaggctgggtctcctccttccacctgctcactcctggtagccccgggggtcgtccaaggttcaaataggactaggacctgtagtctggggggatcctggcttgacaagaggccctgaccctccctctgcagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagag

SEQ ID NO: 5188 - DNA, 1433 bp, Homo sapiens
  ENST00000637987
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccc

SEQ ID NO: 5189 - DNA, 1896 bp, Homo sapiens
  ENST00000371204
cgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 5190 - DNA, 2549 bp, Homo sapiens
  ENST00000492633
atttaatagaagatgaaccagcaaaatatataggaagttgctggcagagaattaggacgaaaatctggagacagtggtatcctgagcaccactggaaggcagtatttcaagaaagaagtgtctactgctgctgcaagtaagacgaggtcaaaaggtatccggaccaattcagtgggtgagcaggccatagtcagatattaaaaggtgttgaggagtgctctggaattgaagaaattgaaaggagtatggcattacctgtgttataaaacaaatgatggtctgtcaaacacaccaaaatttttttttctttgcttgtactcttctttctgtatggaactttcactcctccttgatctcttgattccttacatcatcttttaatgtccaggttagataggacctctcctataaagcctttcttagccttagcctctttaagagtatgggcattgtcttaaccattagtgcattcctagtgtttagcataacataaatacttaactttacttatgtaactaataatcaaagcatgggctttggaataaggcagacctgaaattgaatacctgtttagttgcttacttactgtgagaccctgtaaaatgcattttatcctttatcccttgttcctcagttttttcattagtaaaatgtgtggggtggtaataattgtacctatcccagagagtttctatgagtactaaattatataatgcacaacaaaatgcatattaaagtgcctgccattgcaagcaatcagtaaatattagccattatatccattgctttgggattatttctctgggcagttttcaagtgccttaatgatcttctcctgtccttcatctgatacacattcccatatcatttgctggatattcatattatggaatcagaatactgtaatgttgactttctttttcccaggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttc

SEQ ID NO: 5191 - DNA, 1667 bp, Homo sapiens
  ENST00000466095
gaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaa

SEQ ID NO: 5192 - DNA, 2006 bp, Homo sapiens
  ENST00000469406
gaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaa

SEQ ID NO: 5193 - DNA, 759 bp, Homo sapiens
  ENST00000468257
gtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctggtaggagtgggagaagtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccacca

SEQ ID NO: 5194 - DNA, 587 bp, Homo sapiens
  ENST00000523954
gagaaaattataaaatgcttctcatcagaaaagttagccaagatgcaaggatggtcagaagtttttcaaagcaggcaagatgtcctggagaaatattatgtgcacgaggaccttgaaataggagcacatcatttaggctttctctgggcctctgtggcaaacactattccaactatgttctgggcaatgtattatcttctgcggcacccagaagctatggcagcagtgcgtgacgaaattgaccgtttgctgcagtcaacaggtcaaaagaaagggtctggatttcccatccacctcaccagagaacaattggacagcctaatctgcctagaaagcagcatttttgaagctttacgactgtcctcatattcaaccaccattcgttttgttgaggaggatttgactctcagttcagagaccggggactactgtgtgcgaaagggagacttggtagccatctttcctccagtcctacatggtgaccctgaaatctttgaagctccagagcaaactgtgctcacaggagaaactagaggaatggaaataacagagctctcaaatctgtacttctgtactgcctacagtag

SEQ ID NO: 5195 - DNA, 2202 bp, Homo sapiens
  ENST00000310193
tcattcagcctgggagaccacggtgacattcctgtctgcgctgcgggcaggccagcctctccggccctggactagggggcgccgccgagagaagccgccgcaggctgcagagtcgccgaccgcgctgttcgcaggcagaccccgggctgcccaccgcggcctagcgcgcgccggatggcaggagaagtgtccgcggccacgggccgcttttcgctggagcggttgggcctcccgggcctggccctcgccgcggccctgctgctcctggccctctgcttgcttgtccggcgcaccaggagacccggtgagcctccattgataaaaggttggcttccttatcttggagtggtcctgaacttacgaaaagaccccttaaggttcatgaaaacacttcaaaagcaacatggtgacactttcacagttcttcttggtggaaagtacataacatttatcctggaccccttccagtaccagctagtgataaaaaatcataaacaattaagctttcgagtattttctaataaattattagagaaagcatttagcatcagtcagttgcaaaaaaatcatgacatgaatgatgagcttcacctctgctatcaatttttgcaaggcaaatctttggacatactcttggaaagcatgatgcagaatctaaaacaagtttttgaaccccagctgttaaaaaccacaagttgggacacggcagaactgtatccattctgcagctcaataatatttgagatcacatttacaactatatatggaaaagttattgtttgtgacaacaacaaatttattagtgagctaagagatgattttttaaaatttgatgacaagtttgcatatttagtatccaacatacccattgagcttctaggaaatgtcaagtctattagagagaaaattataaaatgcttctcatcagaaaagttagccaagatgcaaggatggtcagaagtttttcaaagcaggcaagatgtcctggagaaatattatgtgcacgaggaccttgaaataggagcacatcatttaggctttctctgggcctctgtggcaaacactattccaactatgttctgggcaatgtattatcttctgcggcacccagaagctatggcagcagtgcgtgacgaaattgaccgtttgctgcagtcaacaggtcaaaagaaagggtctggatttcccatccacctcaccagagaacaattggacagcctaatctgcctagaaagcagcatttttgaagctttacgactgtcctcatattcaaccaccattcgttttgttgaggaggatttgactctcagttcagagaccggggactactgtgtgcgaaagggagacttggtagccatctttcctccagtcctacatggtgaccctgaaatctttgaagctccagaggagtttagatatgatcgttttatagaagatggtaagaagaaaaccacctttttcaaaagagggaaaaagctgaagtgttacctaatgccgtttggaactggaaccagcaaatgtccaggccgattttttgcacttatggaaataaaacaattgttggttatacttttaacttattttgatttagaaataattgatgataagcccataggactaaactacagccgcttgttgtttggtattcagtatccagattctgatgttttatttagatacaaagtgaaatcttagagaagctaaaaggaaagaaaataaatctatcaaaattaccctaaacatcctaagctcatctatttctttttaatttctgcaaatgtaattgatttatttgtttaaaaagcgctaatttctatttgatctgatatcagtccagtttgtccttagtcacaaagcccatcataatataaaacaggatggtggcaggaaaatggacatcaaaatcaacttaagggtaggctcaaaacagggttgttgttgtttttttagtttctccttgttgtgattttcacctgttataataaatgtaccttcacaccaatagattgggcactgtggaatttaaatcactcaaattgttctctaatatgtaaaattacactttgaactactagaaaattgtgctggaaatggacacagtctaacaaattccaaattctcacagaagaaggaaattgaatttccatgagttacactggatgaaaatgttcccttcaagtataatattaataatacctatat

SEQ ID NO: 5196 - DNA, 2290 bp, Homo sapiens
  ENST00000451137
agaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaa

SEQ ID NO: 5197 - DNA, 551 bp, Homo sapiens
  ENST00000480413
gtgtcgggacctcttggtgggagcagccttccgaggtggccgggctggacgagatcagaggctccccgtcgatagggtcggagacccccgtccctcactgcggcagccgcggcgcccctcctgcgcaccgcgccgagtctcacgcgtatcttctcccccttccaggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggct

SEQ ID NO: 5198 - DNA, 1336 bp, Homo sapiens
  ENST00000261811
tactggcgggactacttgttgcaaggtttatggggaaaagtagccagagagcaatccagttatcagcctcagccccattccgctcaggtacagctcgggaagtaagcccccaaccctagttgggtctggaccaacaagacacgaggaggcagcagcccacagccgacccctcatgccacgcactgagcagggttccgcatggacgctggtcttgcctcccaggcgcctgaactagcggagttggggtatcgggtggagtctcggagaaccaatccaatctgagggggacgcctgtgggagtcctaagtatccagcgcagctgggaggcccacgttgggaagtcggagaccgaccccgcctcccgactgcgccgactgcaagagagcgcttccggcggcgcttggaggccgagcagttgggggcggggctcgtgctgtgacgcaagcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 5199 - DNA, 665 bp, Homo sapiens
  ENST00000509589
cggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacagggtggcgccaggctgccatagcagcaagtccgattttcctccatcagctggcccgcccagcccagccagcccgagaagccgcagctgacagctagctccctgccgactctgccttccctccgaagcagtggacgtgctgataaatgtttaccggtgctctctttaaaaa

SEQ ID NO: 5200 - DNA, 588 bp, Homo sapiens
  ENST00000504227
acttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacagcaggacctggaatgtctgcagcaggacgatccctctgtggagcccaggacatacggaatgctgagtagaaaccacactgaatgaatagcattgggacttagaacagctacttgcacagaacaag

SEQ ID NO: 5201 - DNA, 813 bp, Homo sapiens
  ENST00000509789
acttgctctgagacaggtgcggcaagtctactgcgggctggtccgggctcctcaggttcagacccgaccgttatccagtcggttcgtggagaggagagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacagctgactgtgaattgcttccttggactgaagaataaacctatgaaacacaagaaagttgaaaattaagccacatgactattgaattcatcgaaatcaatagctacatactacaaatattaaactgagcaaattaaaaggacaaatgcatattaacataatacgtcaagctcaggaaaccaccagaagtttaaaccttcttggctgagaaggaataaaggcttaaaagtagattctgctttcttatttaatataggaatcaggcagggaacagtggtgtgggcctacagtcccagatactcaggaggctgaggtgggaggattgtttgagcccaggtgtctgagtctagtctgggcaacatagcaagaccctgtctcattaaaaaaaaaagcgggggggttgcgggagttgggcacagtggctcacacctgtaatcccagcactctgagaggccgaggcaggaggactgcttgagcctgggagttcaagactagcccaggcaacatgatgagacccatctctacaaaaaataaatttaaaatattagtcaggcacagt

SEQ ID NO: 5202 - DNA, 3101 bp, Homo sapiens
  ENST00000299340
agtcgttgccacccgcggagatgaaatgtgagcctgggtggccaaggacgccggagtggccgccttccccgcgcctgagcgcagtggggcgagacaaagagacctgggcccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggacgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtggggagaaaaaaaaaattgtatcaagttccacaggtagcagacacttcacttccaagtaaaagatgagaaatcaattattcccacaggattttaggtcagggagcaaaaatctcagaacttgaccatgaagatacacaacagactcgcaaaaataaagtgggaaatgaagttcagattcccttctgtagatttccttaaaactattatttttttcttcttcgtaaaattttgataatctgttctcttaaaaaagttaatgacacaattaagatactgacatcaaattgttgccttttaccaaaatgcaaattttatgaagtgcctacctttatatgtataaagcatttaataaataattctaatgtgccatattttgctgtgagtgaccttaacatttatatttttatatgaattgtttcatgtatttataaaaattgtatattgaacattggaaatagatgattagatttttgtgtcattttacaattaaatctaaaatgcttaatccaatatcatcatcaaaattcagtgaaatcccaaaacagtgccaagaattttgctgaatgaaacaatcaaacaaagcattttaaggtgtaagttatagtacctgtacttgcagataagaagcttactatatcattattataagtagcatatattactttcaaatacctatattagaaagatattgatctgactgaaatataacctacctgccagtaaggtccaaaggctgaatttgttttgaatgagttccttgatctttaagcactgatgattttcttatatatgaggatgcaaagcattcaagagtttcagcctgttctggtgaggggctccctgacttacataaagttttcagtgcaattttaatagtacatatgctttaatttatttttcttctgcgtgtggtcagacccaattacactgtggctaagactctcaaagtgccagggtttctgtgatgattctgagaatgctgaatacaaatataccttatattctttaaggaaaacggaaaggaaagatcagcagaaatagggttttctcatcttcaccatcaataaacatttattgcgtacctcctatattctgcaaattttccccaaatagaagccagttcagtccacaccatctcttctttgagttgtttatggcctcccttaaggcattttacaaacccataagcctacaatagatgagtatttttactatttgtattaagtgtcataatagcatcaatgtgcacattaccagtatagactgttggagttcactgattgttttcatagatgatgcttcttggggaaaaatagtataggatgtgaaagttttgaattacggttatttaaaaactaacatttgctatggccaaagtgtttacaataagcaataaagtgaaagaacctattataacacagattata

SEQ ID NO: 5203 - DNA, 735 bp, Homo sapiens
  ENST00000400043
cccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctgaatatgaactccatgaggcagagatcttggtctattttgttcaacactctattccaagcatgtaagaccaggcctggtacataatgggcactcagctgaatgaatgatgaacacaactcatgaaaagacctgaattaatcatatatcaataccctagggaattga

SEQ ID NO: 5204 - DNA, 5433 bp, Homo sapiens
  ENST00000284881
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggaagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttgtaaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccagtgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggtttgtgtttagatgagttagggacagtcataaaagttggggatatgttgcatttgatatcaatagtagcatatttccagaatatgagccataagttgcagtcctgaatacaacagtgttatccaaagaaaggagttttctgacaaatatacatagctttgctaatgagtacggaacaagtggatgaacgtgtgcatgtgctaaggtcttaagtgggactctgatttattccatttagatatttctacttaagctctaaaaaggagaggtgctcttaaaaaaaactttgtggtgctggtactcacactactttatttggatgagttcctagtaaaaaaaactttttgttgaagtattttgcacagcagtttatccaaatgtttggtaaacttataatttagtcctatgttagttttcttaatcaaatatgcaattactgtgtatgcaaatataagtatcaggtacagagttgagttctaacaagagaacatgaaatatcacaaatattgttttccacacttggctattctctacagttgttagtaatttttgagaatgttttgaagcatatctcatgtactactgtttaaaaagtggcaaaacagactgccagtcatccattactaaattttcagagcttatatgattaaggggagtgagataagacaaatctttttcacgttcagttttataatttgacacgttaaattgagttttaaaaattagaaaagtgtttttgaccacacaggttgttctctttaaagttcagccttataatgaagctaaaaatcaattatgttttactttgagattatcatcttatcctttgatcctcatattaatatctaaattagtcttttttaaaaggcatgcacttgagactccagtaatagatgattcaggcagcagaatagtgttttgttgtgtcgttgactatgcacaatggtggagcaaagacacattcttagtttttcaaaacacatgttcattttaccacaaagtgcccatttttatatacatttaaggattattttttcaatgtcaagttcatgttagtgatttcagaaatatagtcaaaatatatagtcaaatatatcttgacaggcatcttgagatttggtttttcattttactatatttatgactgaaaatggttttgtgttttctttatgttgtttatatattttttaccttagtgtttacactggtaaggcttgttagtccatttttgtagtttttttaaagtaagcttttagatctatttgtgttttaatgtttcccagtttgggttttgttttgttttggaagaatctgctttcattattaaattataaaatgtaaatgctctaaagtaggaatttttaaagagtaaattatttgtgtagcttattaggaggttcaggttagtgaccataaagtgggttacttgtacatgaaaatttgaaatggtaccatgtaaaattcttctattgtcaactttttctgatgtatgccagttcatttactgacaaatgttgttactaagtgcttattaagaagtgtaatacgctataaaaaagttaatactttttgttcagatgtaaggcaaagataattgatgccgtttcagtgtatgattgtatttttaacttttacgttggtgggagtaactatttgaggaaatttgtggtgagaattagtaagagataaaacccccaacagtttattcttaccaagtaaagttttgtggtcatggggcagggaagagtttatttaccagaatactagagccctcacacaaaataaaggtaacttggaggagggctataatgcttgcatctcagtattttcatttcacttcatcctttcataattgccttgattatggtgcagtctaacctattaagcaacttctggctatggtaacattgatatgaaccatattatatcaagtctccaaaacatctagtttgttaacatacactttccctgttctttttagtttgagtccacattactaatacattttaataatatttaattatttcacaattttaagtttaccaaagtaaacaaaaattcatgaagatgagtattgccctctcccaaaaaaggtttaaagattagttgaacttccctcaactacacctaaagcaaaggggaattttagtaagtgtgtgtaccttgtttctttcagacgcatctagaatgtttttctttcaccgtacctccaaaagaggcaatttagaaagtattaagtagtgacttttgttcagttccattttgtgtgtgtgtgtgtgtgtgtgtgtgtgtgtgtgaaccttgctttaaaacagtagcgtatactatggtcattgaacttaatctctctggtgttagaaatttactttacaaaattgtgttaagacttttggaaaaagaaaatgaaactgctgtggtaaaaaccaagtttgtttcaaaaaagtaggcaattatttggctgttatattttctttgaaaactgcaataatttatatatttgtattgctctgcttgggaactgtatatatgcttgtctactatttttaattttacaacaataaaataagtattttgttatctgcta

SEQ ID NO: 5205 - DNA, 1593 bp, Homo sapiens
  ENST00000400559
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccaggtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactctagtcttctagggctaatcattttggctcatttggggactcttttttcccagaattactaaacaaattttatcacatgtgactacttaaatatactgttacagtgtcattttattaaacattttaattcacctgtcaaaacaacagattaactccttagtgtaaactactagagataatttttaagagggaaatggaattcatatcacctcttatttattatgagcaatattttaatataaaaattttatatgtgaaaatgctattttaggtactttgccattctctttataaatgtgtatttgagtggttctgtatatttatttacattatcatgtgtgaatatgttcacccatatttcaggtcactgcattttattctcttaatacaatgttttcacaacggttaccttgctttccaaagataaatatattttggattagaaa

SEQ ID NO: 5206 - DNA, 1090 bp, Homo sapiens
  ENST00000400558
gcggccgcctctgctgcggccggaaacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaataagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactcta

SEQ ID NO: 5207 - DNA, 896 bp, Homo sapiens
  ENST00000405964
cccggagcgatgggacgaggctctcccgcccgccgggctccaggatgccgcggctctcccagctccggcttgggcccctccggcggtgcccggccggtaccgtgaagccgccgctcggccttcggtgtagttgccccggacacggcgggacgccctccccgggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaattgaattcgatgactcttggtgaggtagagcaactgaatgcaaagctcctacagcaaatccagg

SEQ ID NO: 5208 - DNA, 744 bp, Homo sapiens
  ENST00000493464
acccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggctgaccttgagcaattctcccacctcagtctcccaggaagctgagattacagaaagaagacaaagatagatttatctctactttagaggaagtgaagtgtcaccctctagttggaagaaactagtccaccttatgctcagtaaatatttagggaatttatacttttaggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgt

SEQ ID NO: 5209 - DNA, 665 bp, Homo sapiens
  ENST00000482915
aacaatagtggaggaacccgagccgcacggaacggcggtggtggcccgcggagccggacggggcactatgaacgaagaggagcagtttgtaaacattgatttgaatgatgacaacatttgcagtgtttgtaaactgggaacagacaaagaaacactctccttctgccacatttgttttgagctaaatattgagggtaaggacacagtatagttttgatcttatggaatgaatttaacacagctgctttgtactgattgtaaggtaaaactaaaatgtcttcaatgattggaaattgtgctaagtatgaatagtgtagagatttgttaaagataaggtttctggaaatgaaggtgcagttaacagagttacgaatttaagagaaatcttttttttttaaagacccctgcaacaaccccatttttcctaatacagaaataagtatgagtgttgactgggaaacgtgttttctggtttgagagcttattgaattgtcagattttaacagacctgtgtgttttttatattaagaagtaacataacaatttttttattctttcgagcctattatgcaagtatttgagtgagatgagcccgaactcttttctcaccagtatgatcttattatctggaaaaatactttaaaatttttagattaacctctttt

SEQ ID NO: 5210 - DNA, 2507 bp, Homo sapiens
  ENST00000526400
aaccttccaaggattctaccgagtccctggtccaaccggggcctaaagggggacaagaagcagccgatgtgtcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaa

SEQ ID NO: 5211 - DNA, 11678 bp, Homo sapiens
  ENST00000321505
gacattcccccactcctccctctacctccatcctcttcattggctcctgactcacctcattccatcatctctgagccagcagagcaatcccccaaagtgctgttagttccccaaacagctccagccgacccctctttaggtcagaacatagctaatcccttaatcccattttctgatgaaatggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctataaatagacctgattctttgtttccctcgtcaattaaacaaaggccaagaaagagagaagatgagagggaatggtggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatcaataataatatttcattagtgcaatgatatcaaccagtactttgtctacttggtaaatgcctggaaatactgtatgtgaaaatgatgtttcaagatcttactgtaattgaagtatacgtaaatgtttcagaagacagtgtctgaaatttggctgtttcaatgacttacagagactgagtctacagtttgcagagctatggctccagagtgctaagagggtggagtcacaaatcactgtggtctttacagagccccaggaaatactgagtgagtcaactgagacgactaaaaagatagcatgctaaatcagatactgtcttaaactagacaccatgggttcaagaatagtattaatagatgagaggaaaaccttaagttggaaagaaatcagtctgttcatgttatcccactcatggggagacagagccactctggtcagattttctgtgagtgagatgtggtcccttccctgaagaatctcctaacctcatagaggtgagagagatgactggacagctgactctaagagatggtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaagcagaagtaccacgaagtggagtgactggcccagtgattcagtcccaacctcctggttcacgaacctgcttgctttccatctcgccatgtggcctgcaggcttgtcagtaacacatttctttagctgtgcctagaggtttaaaaaaaagataagggtcatatgaagaactccataatgttcttgccaagaaaaaagatgattgagtatataacgaacttcagatacagtgtatagaggatgatgcatttgtggcataataaatagttttcagtgctggttttgatatgagttttctgcattcatgaaaaagaaatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgttacctacagagcaaggagtttcctctttcagggtagattatgtaagaatcaattccctggtcccaggagaagttttattgtgagtttgttaatttaagaactcactcagcagaaggacatgtaatgtctgagtaatcttgatggaagaaaggaaatagatctgtgattaaaacacacacacacacacacacacacacacacacacaccctacttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagaaggaatatttaggaaatataattgtgccacacacacattactttagaagatatgcagttgctctgattctgcaggtttaaaaaaaatgggaagtttgtgatatggcagaatctgtctccattggtcaaaccatacttcagtgagagccattataagtgaaatctaaaaattgatcgttttcattctctgactttggtcagacttttgcaaattatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaa

SEQ ID NO: 5212 - DNA, 4492 bp, Homo sapiens
  ENST00000265654
tcattccatcatctctgagccagcagagcaatcccccaaagtgctgttagttccccaaacagctccagccgacccctctttaggtcagaacatagctaatcccttaatcccattttctgatgaaatggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacaggtgcagccactaatgcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcaggtcgcccagtgagaatggctctgtcatcagcaacgaatcagggaagcccagctcagggagacgctcaccccagaatgtaatggcacagcagaaagtgacaaaggaggaggcaaggaagagaaatggtgagaagccttccctccaagaaccacccccagctgctcccacgcgtgcccgcacacacatgcgtgcacacgtgtgcacaaactcacacacagccactgggctctgaccctcagtcgttctttctattctgccccacaagggccaggagtctgtatgtaccccttgggttctcaccttaccccttgtctgaattgtcctgtctcacttcctccgcccctgttcttatgaaatggtgtagttccttaggaaaaaccttttgcggaatgaactgatgtttgcttagaggtttttctaattctctagttagaaatcctctaaaatttctaatttctaatcacatgaattgacgcaatttcttgcaccagttccactaaggcagcagatctctgaaataactgctcatcttggagattcctctcattttcctgccctgactcccctgataagtttcatgggttcagtctgtgccactgagtccagatattgcaactccacttctcccaggaaaaaactaacccaaaacaataaaggaacagatctgtcatc

SEQ ID NO: 5213 - DNA, 2507 bp, Homo sapiens; identical to SEQ ID NO: 5210
  ENST00000526400

SEQ ID NO: 5214 - DNA, 11678 bp, Homo sapiens; identical to SEQ ID NO: 5211
  ENST00000321505

SEQ ID NO: 5215 - DNA, 4492 bp, Homo sapiens; identical to SEQ ID NO: 5212
  ENST00000265654

SEQ ID NO: 5216 - DNA, 440 bp, Homo sapiens
  ENST00000566023
gcttccggttcgagctcccggaaccgccgcctctagggatggacggtcagactctgcgaaaggccgagagaagctggtcctgctcacgagagaaaaaggaggtaaatgtgtccctggcgagggctgatgggaggcaactctatttgaaaggacctgagggagcagggtggcgaataagtgtccctaaatatactcttttctcttggggtcccaagcttgaatcctggagcaaatgatagtgagcaactagacttaccaacccagtgtcacttgtaataatcacttgtaataatcacttgtaataatcatctctgagtgtatcagttaactttgtctgtgtaacaaatcatcccagattttagtggcttaaaacaacaaccatatatttagttctggatttggtgggttagcagtttgggcttatctgggcagttctgctg

SEQ ID NO: 5217 - DNA, 6616 bp, Homo sapiens
  ENST00000261588
ggaaccgccgcctctagggatggacggtcagactctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcgatcttgacattggtgccaagaacgtgaagctttacgtcaacagaaacctcatcttcaatggcaagttagacaaaggagatagggaggccccagctgaccacagcatcctggttgaccagaagaacgagaagagcgagcaactagaggaggccatgaacgctcactcggaagaaagcaaaggcacccatgagatggctggtgccagcggggacaaggagcttggtctcggttgctcaccgccagctgaaacattagcggatgcaaagctttcttcacaaggaaatgtgtctggcaaaagaaagaattctactaattgcaggaaagacagtttgtcccagttagaggaatatttgagactgtcggcagtccccacttcgatgggtgacatgcccagtgctcctgccacttccccacctgtgaagtgccctcctgtccatgaggagccctctctcatccaacaactggaaaacctcatgggcagaaaaatctgtgagccacccgggaaaaccccatcctggttacaaccttctcccaccggcaaggacaggaagcagggaggcaggaagccaaaacccctctggcttagtcccgagaagcccctggcctggaagggcaggctcccatcagacgatgtcatcggtgagggtcctggagagaccgaggccagggataaaggcctacggcatgagccagggtgggggaccagccggagtgtcaacaccaaggagagaccccagagggcaaccaccaaagtccacagtgatgactcagacatctttaaccagccccccaacagagagcgccctgctagtgggaggaggggctcaaggaaggatgctggcagcagtagtcatggggacgaccagccagccagcagagaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccgggccctggacaagttaattgatggcaccaacatcaccatggaggatgagcatatgtggctgatccccttctcgccggggctggaccatgtggtcacgatccgcctggacagggccgaaagcatcgcaggcctgcgcttctggaactacaataaatctcccgaggacacctatcgcggggccaagattgtccacgtctccctggatggcctgtgcgtctccccgccagagggctttctcatccggaaggggccaggcaactgccactttgattttgctcaagaaatcctcttcgtggactacctacgggctcagctgctgccccagccggccaggaggctggacatgagaagcctggagtgtgcaagcatggactacgaggcaccgctgatgccctgtggcttcattttccagtttcagcttctcaccagctggggcgacccctactacatcggcctcaccggcctggagctgtatgacgagcgaggagaaaaaatccccttgtcggaaaacaatattgcggccttccccgacagcgtgaactccctggagggtgtgggcggggacgtccgcaccccagacaagctcatcgaccaagtgaacgacaccagtgatggccggcacatgtggctggctcccatcctgccgggcctggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaata

SEQ ID NO: 5218 - DNA, 746 bp, Homo sapiens
  ENST00000568258
ctctgcgaaaggccgagagaagctggtcctgctcacgagagaaaaaggagggttacgctaaggacatggtgacagactttgatgagaaacatgatgagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagac

SEQ ID NO: 5219 - DNA, 767 bp, Homo sapiens
  ENST00000565672
agagaagctggtcctgctcacgagagaaaaaggaggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagac

SEQ ID NO: 5220 - DNA, 392 bp, Homo sapiens
  ENST00000618117
gagtatttaatattgcttcagcagaggaaccggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccaggtctggagactgtggccccagcccacgctttagaatacagagtgtgggtggctgtgggaatagaaatacaatcagagcatttaaaaccccca

SEQ ID NO: 5221 - DNA, 564 bp, Homo sapiens
  ENST00000564749
actcctggcttgggggtacagcagcccagactctcaaatgatgaggaggaacaacccaccgtttctctttcaggatattaaagcatttgaaaagcaaggaccccgtgcaattgaggctggagcacttggagcaaggtttctctgtctatgtcaacggtgccaattcggagctgaaatcatcaccgcggaaagctattcactctgacttctccagaagtgcctcccacacggaggggacacacgattatggacgaagaactctgtttcgagaagctgaagaagccttaagacgcagttcacggacagcccccagtaaagtccagcgccgaggatggcaccagaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtgg

SEQ ID NO: 5222 - DNA, 2262 bp, Homo sapiens
  ENST00000567894
atggatcccatcgtcaaaaaatggcggcattagcaggatctgagggtggaggttttggccttctgatgtcaaaaggcgaatcgggagacacggaaaccctcactgtgcatcctctatagaggggtcagaaccactccatgaaatctgtgcagatcagaacagaagctggcccacggctccacatcgaacctcctgtggactattctgatgattttgagctgtgtggggatgtgactctccaggcaaacaacacttctgaggatcgtccgcaggataccaaatctcccaccagtaccaagccctgtggttttaacttctcccttctgaatgcatgtggacattctgacccttcaagcagcgtggacaaagaaaggatcctcttaactattcaggatgtgatggagctgagaagaagcctggaacttagtgtaaatctacaaaggaaacaaaaggattgttccagcgatgagtatgactctattgaggaagacatactctctgagcctgagccagaggacccggcactggtgggccatcccagacatgaccgccctccttccagtggcgactggactcagaaagatgttcacggggaacaggagacagaaggacgctcttctccaggcccagacaccctcgtggtgctggaatttaacccagcttccaaaagtcataaaagggaaaggaatttgtctgcaaagcggaaggacaatgctgaggttttcgttcccaccaaacctgagccaaacctgactccccaagctcctgctgtattcccagaccaggagaggatgtgctccagacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcaggatgcagaaggaccaccagcaaaaccatggaccagtctgctggaggagaaggaagagacccttgagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagaggacaaacagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggctctctctctgctgcccaggctggagtgcagtggcgtgatcatggctcactgtagcctcgacctcctgggctcaagcgttcctcccacctcagcctcccaagtagctgggactccaggtgtgcacaccacacacagctagtttttttattttttgtagagataggctggtctcaaactcttgacctcaagtcatcctcccgcctcagcttcccaaagtgctgggattacaggcgtgagccaccacgcccggtcctgattgaggaatttaaaagactactctggttgatttggagaatggatcagggggcagagggagccccgagagaggaggctcaaggcatagaacagcctaagaacagcctcgctgaagatggtggtggcctggatgagggtgtcagtgctcttggggtgcactttaggtgggctcaactcatcctatgaccatttgcattttcagcaatgcctttttctggaaagaagttttcaaatgaatgcaaaagtgaagagattagttcagtaatgaggcgtgtatccatcacctgcttcaataattacaaacattctgctattgttgtttcacgtatccccttaacatttgaaagtaaattgtagctatcacactatttcactcataaatccttcagtatacatctctaac

SEQ ID NO: 5223 - DNA, 3237 bp, Homo sapiens
  ENST00000573850
gacctggaagccggcgagagagacccctgtctgcaacccgcaaaactctttgcgaggctgagtacccagaggaagatgcctctgctgtgctccaagccatccaggtggagaacgcagccctgcagagggcgctcctcagcagaaaggccgagcagccagccagcccactgcagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcggcagggtggtttcaccaaccaaggagcaagtatcagacacagagagaatgagggcagacgagatcaaagatgccatctacgtgaccatggagatcctgtccaactggggcaactcgtggtgggtgggtctcacagaagtcgagttctttgacttgaatgacacaaagctttatgtgtcgccccacgatgtggatatccggaacacagccacgcctggggagctgggccgcctcgtcaacaggaacttagctggcaagaaagactcctccccgtggacctgccccttccacccaccactccagctgttttttgttattcgaaacacaagacagctgggggacttccatctggccaagatcaaggttcggaattactggacagctgatggcaagacacctggtcttccaggacgccgtcacggtcaaggtggcgcagtgagcaggagcacacacttcacgagtcatggagctccctcagtgccttcgaccgctcccaccggggacgcatctccaacacggagctcccgggggacatcctggatgagctcctgcagcaaaagagcagccggcacagcgacttgcccccctccaagaagggggagcagccagggctgtcgagagggcaggatggctactctggagagacagacgctgggggtgactttaaaatccccgtcttgccttatggacagcgcttggtcattgacatcaagtctacctggggggacagacactatgtcggcctcaacggaatagaaatattcagttccaagggtgaaccggtgcagatttcaaacataaaagcagaccctcccgatatcaatattttaccagcctatgggaaagacccccgcgtggtcaccaacctcatcgacggggtgaacaggacccaggatgacatgcatgtctggctggcccccttcacgcggggcagatcccactccatcaccattgacttcacgcacccttgccacgttgccctgatcagaatttggaactacaataaatctcggatacattccttccgaggcgtgaaggacatcacaatgctgttagacacccagtgcatctttgaaggagaaatcgccaaggcctctggaaccctggcgggagccccagagcactttggagacacgatcttattcacaaccgatgatgacattctcgaggccatattctattctgatgagatgtttgacctggatgtggggagcctggacagcctgcaggatgaagaggcaatgaggaggcccagcacggccgacggcgagggggatgagcggcccttcacccaggctggcttgggggctgatgaacggatcccggagctagagctcccatccagttcccctgtcccccaagtcaccacgccagagccaggcatctaccacggaatctgtgagtagctctcctggagcagtgttgggtggaaggaggaccttccagggacagggggagttgtggccacttgggacagggtttcgctggacaatcgggtgggttggacactgtacagagacaccaggccatggggcaagtggaggctgaaaccagcctgcgctcagctccctggccctagcagggccacctcactccagaggaggggcatctcttagcattttgccttccctgaggggcatttttgcatgcagacaccctatgtgttagctgtgaccatgaccctgacccaggaggtgtagttggcacccagaaagtgtagaacaagaggacattagagcctgaagagacccaaggcatctgttggtgcagtgccccgagctgtctcttccaactccaccaaagagtagatgcacaggcagagaaaacctgcatccactctgccccgggggtgggggcaggtgcacaggcccagggtaccaggtcttctgacttttcagaagaagtcggaaatctagagtcttacgtgaagtctccagattctcaaatgtgtgtaacgaattttctcatgttttaaaatatcacatgagccaaataaaacacttattgtgtatctggccagctggctgccagtttgtgacttctgagcaaatcccaggggttttctgctgggcctgttcctcacccttcttttccattgatccttccagccagttcctctcttcatccatgcgtgtccacatcagcccctccccgtcctggggaatcttcaagcccaaggtcactgctgattgtgatctcctccctcctgcaccctgctaaccaggttcctggcagcctcacttcctgctctctcctgccccctgtgaatgtgacccgcttctactttatcttctgagacaaaagatgtgacactgtcaggatcccctccccacctccccatcctcatctccaaaatgaagctggagcctctccgaatcctggtgtcagcccttccgggacctccccatgccatctctggagtccacctgcaggcacctgtgcaagccacaccttccacctaggatgcctccctgctccatctctgccttctgacgaccacctgtcgctggctaggttccctagacacagaccctgagatggagtttcctggggtgtgctcttgtcagggaagggtaggaggcaggattgggcagagggagaagctggtctgcggttcagccacttcaaggcctcagcctgctccacagggagctcggaacctgggatggccctttggggtcatcctgagttgagtgaggggccatgtctttatctgtatcaacatggcactggctatgggctgcccctggggaggggcatggctttttattttactttttaatttgtatttatttattttgacacagttttactctgtcgctcaggctggaatgcagtggcatgatctcagctcactgcaacctccgcctcccaggttcaagagagctcctgcctcagc

SEQ ID NO: 5224 - DNA, 321 bp, Homo sapiens
  ENST00000562207
gctccaggcagttgctgtcaccctcacattcctgttcctgttttctacaaagggactgtcagcctgagcatgcctgcccttgaccgtgaccctgctgtgtcttaggccaggagtgttgcctgagacatctgtttaataagcctttccatcctcagctgcttcccatcaccacggcgactactactcaggagccggccggggcagcaggaggagccagggccatcaaccaggccatggacagaattgggcttctgggaagcagacaacagcagaagcttctgaaagtcctccaggccgtcgaaagtgactctgcccatctcg

SEQ ID NO: 5225 - DNA, 570 bp, Homo sapiens
  ENST00000568622
agcccagccaagcgcctctgtttccaaacatgcctgttttaattagtgccgctctctgacaggtgaaccgggtttatgtgattttcgatctgcctaccaccgtgtcaatgatcaaactgtggaattatgcgaaaacaccccatcgaggggtgaaggagtttggcctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcagtaatcaggccgaggatcaagatgtccagatgatgaatgaaaaccaaatcattaccaacgcgaaacggaagcagagcgttgttgacccagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaag

SEQ ID NO: 5226 - DNA, 816 bp, Homo sapiens
  ENST00000451342
agacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagatagagacggggtttcaccgtggtctcgatctcctgacctcgcgatctgcccgccttggcctcccaaagcgctgggattacaggcttgagccaccgcgcccggcccaactcttgggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaataca

SEQ ID NO: 5227 - DNA, 1238 bp, Homo sapiens
  ENST00000341287
agcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaaaatgaa

SEQ ID NO: 5228 - DNA, 979 bp, Homo sapiens
  ENST00000451346
agatgcgcggatgcttcagcatgcctccagaagcagagaaagaacaaaagcactggaaccggtctccggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaa

SEQ ID NO: 5229 - DNA, 748 bp, Homo sapiens
  ENST00000428015
tgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaa

SEQ ID NO: 5230 - DNA, 722 bp, Homo sapiens
  ENST00000453017
gctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcac

SEQ ID NO: 5231 - DNA, 460 bp, Homo sapiens
  ENST00000423952
gatacctgctcagctggctaagcctttaacatggaaagaaggctcataaagaaggaaatgaaaaagctcttgcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaagga

SEQ ID NO: 5232 - DNA, 386 bp, Homo sapiens
  ENST00000449053
aagaacaaaagcactggaaccggtctccggttggtgagcgattctcaaaggggaatttgttaagagcaggcacttaatagaacagcccgagagacctgtaccacgattgcagcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtggg

SEQ ID NO: 5233 - DNA, 1595 bp, Homo sapiens
  ENST00000424927
cttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattattataaaaattcaa

SEQ ID NO: 5234 - DNA, 1012 bp, Homo sapiens
  ENST00000480379
gaggacagatgggagaggagcacggctgggggctgaggcccagccggcaaggagagcgtggagtcactgtgaaggaggggctgcggctgcagagacgctcaggatccagggatgggtctttgagcagtgaagaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttc

SEQ ID NO: 5235 - DNA, 2995 bp, Homo sapiens
  ENST00000356858
gggaagatggccatgtgcaggtggaggcagagattagagaggggctgtcccaagccgagggacacagaggatgccagacaccacgggacactgagaagggcaaggaagggtcctcccctagggccttcagagggagcacggtcctgacacctggatttctggcctccagaactgggaaggagtaaatccctgttgtatccagctgctccctttgtagtcacttttcacagcagcgctgggaacgaacgcaggcaccaatccagcttgggggccatgtggggtagcagcggatcgggacttccttctaagagaagcgatcttgagccgtgtcacgggtgaggagttaggagttagctcagtggggaaaaggtgaaggcagcactcacggtcatcaagccagcccctgtgggaagcaggctgggtttaaggatttctaacctgggctccttgaactcccagggtccccctacatgtgtgcttcaattttgcaccttttcttggggagaaacgaatcccttgcatttgagttttggaggaccatgtggccttcacggtcacaaactggcaatgtcaagaaggtttggcaggaccggctgggagatgaggctggtggggtcaccagcttgattgtgaccttgctgacaccagcagggcagggaggtgaactgacgcaatggagcagagcctttgtctcaggagcaaaccagccttggctttcagttggatgttggaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaaggtaatggcctcgtcaccagcaggtgtgatgtgtgtggtgcacagatgccgaatctcaacttgacatctttgtttcccttttcctctagcaattactggaccagctccttcaaaggaatgcggtctaaccacaggctgccctgctgaccacactacctggacctgggaggacttcgaatgctggataagccattaaacttagcattatcttcatcatgggaaaa

SEQ ID NO: 5236 - DNA, 2107 bp, Homo sapiens
  ENST00000432642
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagtt

SEQ ID NO: 5237 - DNA, 2035 bp, Homo sapiens
  ENST00000368674
ctctcacacatgccctccctcgatggcccccagctcttgtaggacaagccctcatggcagagctagatggcaccctaggggccatacaggtgcgtgcactccttgcctcgcggatgaggaagatgagcccagaggaggagctgacatggctgagtggccaggtgggatctggagcctagtgtccttgccgtctggacccctcccagcatatcatgctgtgtcctactaaggctcccaaaatggggacaaacttttcatctttcagcttctcccagtgcaccttcttgctgcctaagccctgactctctgcttaggtttcaaaaaatgagacaactcatgagagaaaagaaaatggtcagatccgcaatgcatggaaaaatatctctttatgtgtgtcatctcctcaagactcccaacaaagcctatgccagcctctctcttacagaggaacaaacagaggccaggaggttacgtggctcgtccaaggctagacagcattaaaatgtggtggcaccaagagtcaacctggaccaggcgtcaaaactcaagctgttctacttttaccttctcctaatcatgtacagtgattattcatattgcaaactcgcagctttagtcttactggaggggtgacacctggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagacttattacaagaaggacaacataagcagctatcaatgttccaaagataaatcccactttagtggttaaagagattgctcaagctaagcacttcgtcttccttattgatgatgattccagaaatacaccactgcattgttgtatgttaccccagttaaagcacatcctcattttt

SEQ ID NO: 5238 - DNA, 1025 bp, Homo sapiens
  ENST00000488181
cgcaggggtatgctgcccgctacacagaaacggccgtgcatcggactttccagataaaaacatttagtacagagttgaaaaaccatgtgatggtcatggattttgtgaagagtaactggtttccctcccagagaagagccaaagtttgtatcatccatatgtgtcaaggcttgaagacggctgagcagacagccagcagatatgagatccacagtcgactcttctcatcccccaaagatcattctgcctgggaaagaaatgaaagtctttccaatgcaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtg

SEQ ID NO: 5239 - DNA, 566 bp, Homo sapiens
  ENST00000463082
aggctggaaggtggaagcctgactcattctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggtttagagcttgtccctgggcgtgcgctagaaggctgccataagatgatgaaacactccagggactgccctgctgccctgtgactgtggctgccgagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaat

SEQ ID NO: 5240 - DNA, 3076 bp, Homo sapiens
  ENST00000284694
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattatt

SEQ ID NO: 5241 - DNA, 5017 bp, Homo sapiens
  ENST00000409663
agcgagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 5242 - DNA, 538 bp, Homo sapiens
  ENST00000445960
cgagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatg

SEQ ID NO: 5243 - DNA, 5017 bp, Homo sapiens
  ENST00000409959
gagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 5244 - DNA, 806 bp, Homo sapiens
  ENST00000462540
atttaattttaattgtgggaagaaaggcagatacaagcccactgctctgaggttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggtcattttaatagatttactttgaatgctggtggccaccaaactttgtaaccttctcagaattggttattttactattttctgctttttgaaaaaattatatagaagtaatatacatatataaaatatcagtggattccacctaacttctttttaatggctgtggagttcacagtgttgatattccagagtttgcttaatcttattgttggtcttttgaaatgtttcctgtttttcactgttattaccgttaggccatatacctattttataagtttctttaattttccttctgaatcctctgtttccttggggcatgtttcataaagaggagagattctttagttaaagactgtgaacgattttgtagagcttgttaaatcttaccagcttgcttttcaggg

SEQ ID NO: 5245 - DNA, 4299 bp, Homo sapiens
  ENST00000240487
ccagttccctgcagggtaattccagcaatggggaaaacttccttcagaattattttcttacctactgaagaaggaagcattgaaagttccttatttattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaa

SEQ ID NO: 5246 - DNA, 567 bp, Homo sapiens
  ENST00000509565
cacatgggacttttcttttatttcaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggtattttcta

SEQ ID NO: 5247 - DNA, 882 bp, Homo sapiens
  ENST00000497247
gttatatcctagaacagaatctataattgttctagaaattaggtagaaatcattctttgagcttatgttggatttttttcgcattttagtaatgtagatcatggtttggtttattcaataaatatcgatccaataaattattttaaataaattttatagttcacatatactaaatatctttttttggttcccattagaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaagtaagaattcttatagtgtggttgggagcgggggcggtttctcacttttgatattactcatttctgatttaattttaagtaaacataaattttgattctacatttgctttcataaaattttaagtcattatgtgaacagctgccccattattattatgagat

SEQ ID NO: 5248 - DNA, 734 bp, Homo sapiens
  ENST00000478919
tggcatgctacactttgtttgttgtttgtctttgctcacttgaatgtagcttgttcactgctgtatcctcagtatctttaatggggccttgcagaaagtagttcctcaaatatttgttatgtgagtctcatcttgtcatccaggtcaagagacaatcggacactgtctgaagaaacggtcaaaacaatatgctgtatttcagaattatatcctgaaattatattccgaaaggagttagtcagcatgtgtgggtgacattagggagtgttttctggagggaagggcaggtgcaggaagggtaggatgagggccaggtgaggatagggtggactcaggccttgttctcttccgtaggtctttactcacctggagacctgtggcccactccgccagtgtgtgtgacaagcagcttaaactgcaccctggagaacggcgtgccttgtgtgattcaggagtcggccccggttcataatagagacagagtcttgctctgtcgcccaggctggagcgcagtggtgcaattatagctcactgcagccttgaactcctgggttcaagcggttctcctgcctcagcctctcaagtaactgggactacagtttcattgattggagtgcaacatgcgaaggccagttttccagcgcatactgtccattggaattgaacgattacaatgcctttccagaaggtaagggctcttcagacaatcccaacgccattattttattcttaga

SEQ ID NO: 5249 - DNA, 5298 bp, Homo sapiens
  ENST00000371236
cccagctcggcgctcgcccgggcttccccgggctgcagagcgcgcctgagtgccgccgcccgccgggcatggggagccgcttcctgggcggctgcggcagcggaggaggatgctctgggctaggcgagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaagtatagaaagatccacccaacattaaatcagaaatcaagcaaatgcttacccaacaaatatttgagccctcatagctgggtttaagatgactcagtgtgcaaaattattaattccctttttatttctctacctgttgaccactgttgagacaccaaatttggagtgacaggcatcagaggattacaacagggttggaactgacttctttaagcaaaagcaaagggtcttctgtgaccacaatatcgtcatccatatgccttttcacataggatgatgtgttttttgtcactccatggggcctggtctgccattttcccccctttcctttttttgtcatgtttgaaaattaataggtgtacaaatttttgtattgcttttgactttttttagatatgggtgaagaaatctaactggggagaaaaaaagcctcagtgaaatgaattaacttgaaattacaagacaaataagtggttgattattcattatgatcacgaatgttgccaaaacagtcctttagctattctgcatcctggtgaagaaagacagctttcagtacgaaccttcattctgtgagtaggaaaagacatcagatcccattgatgagaaagatgaaaaatgcatctgatttcttaagaagctctaaactctaagtacaataaaatgatattttttatttttccgatatcttgctgctgtgttgctatgcagacaagtgtcttctccacgtgccattttcaaagaaaagtcatttgccaaataattctggtacaattctggtaatgtggttttggatcttaaaaaccaactttctaatggaacaatggtggcataaatattcagaataacaaactgattctgtggtccaaatggttcatctctatctctttttgtacatcagaaaattcaaatgggatttttattttataacttgaaaaaaaaaccttaccattaaactctttaaatatttaagggaaatggctttaaggagttctaatgaaaaaaaattgtcttttttttgtaaatataaatgttaatgaaaatgatttttaataatgccattacactgtagagaaggtagcagattgagtgcaaggtgtgacaaacttgatggatggggctcactttccagacgttattctggagcatatggtaggaagctggagtgcagggacagctggcaggagcagttggccaatcagcagctagtgaacgggaagggagcacgtgactccatcatctagcctttccacgagagtccccaccctacgtgcaacacaagaaaaagacaattcacattctgaagaattcagattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccaggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagaacaaca

SEQ ID NO: 5250 - DNA, 2668 bp, Homo sapiens
  ENST00000485760
tctgcggtgtcaccgctttcgcttctgcttgatatatgtttaatagaccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcagatttggtgagtcttgaatgcccctgaaaaccattctgctccatttcaaaagtacttcccagtcttcgtattttacctaaatgcaaattcactgccttggagagtgtgagtccaagaagaaatcctttgggctatttccttggcttctctccatgacgattcctgactcgtggccccggcaatcttgggaagacatcatccagcttcttcagtccagaccctgggcaccccccttttgccaggatcgtccccacccagcctggacacattgactgaactgttttctaggacactgcactcagcaagacatggtggtgagccctgactctcagtcttcatgattgaagaactcttttgtacaacacaaagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaa

SEQ ID NO: 5251 - DNA, 1802 bp, Homo sapiens
  ENST00000371231
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctag

SEQ ID NO: 5252 - DNA, 752 bp, Homo sapiens
  ENST00000371232
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcc

SEQ ID NO: 5253 - DNA, 647 bp, Homo sapiens
  ENST00000332102
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggttcccaccagccaaaagaaggaaggtgtttatgatgtgccaaaaagtcaacct

SEQ ID NO: 5254 - DNA, 1150 bp, Homo sapiens
  ENST00000371230
cccagctcggcgctcgcccgggcttccccgggctgcagagcgcgcctgagtgccgccgcccgccgggcatggggagccgcttcctgggcggctgcggcagcggaggaggatgctctgggctaggcgagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccaggtaatttctgaaactagtcggggttttagattcaagagtgactagacctgtgccagagccattttgtcagaaacctgaagaatccactgactgcaaaacctggagagagaccaagattatttctgagggtgagggctgccagcccctccaggagcaaatttccataaaaactaacagaagtttggccggcatcggtatcttgggatttggagatccgcttctcccttcttgcctctgcctcggcccccttcacagtctgtaaaagtttgatcccagagctgaatgtttt

SEQ ID NO: 5255 - DNA, 637 bp, Homo sapiens
  ENST00000489267
tctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggtatacctgtgaatttatccttgcgctggagatcgggccttcaaataaacacatgtaaaaactgacagtcaggccttctcttcctgctgccaagtagaaataaacgaagatgaaagattcctgtgtaaattacaggacccaaagcaagccattagaaattattccttattctcttaaactctagacatgttagatgaagtgaaatctcgaatccagagaaagatttcaggggtggaggacccaagaaacacaattgcttttgctgttgttaacagtgcgggtggaggtgggagtggctctaaggattttgacttttttgtgttttttctaccttgatggcccac

SEQ ID NO: 5256 - DNA, 722 bp, Homo sapiens
  ENST00000473821
ataatctaattaaggtagcataatatagagccagaagtcaggtggtatttacaaggtacagaagagatcttggactcaaaaggcatggagtccagtcctatttagctggaaaatctgtggcttatatcatctccaaccatggtaaaatgaggacagcaccatgaagatgaaatgaaagcacaaaagagaaggtatttggcaaaccatgacagtcgttgttagaaaggaaatgtcaaatgagtgcacaaagagggacccgaggggaccctcctaaaaaactgcaagatcctttcctttcactgttgctatgttctgacaaggtttgttgtcttcctgttaaatgggaggtgagtgtggagtggagaaagcgagttgtttgggcctcaggcctcaacctccacttgaagcctacacaagctcacctttgctaccctgcagagaaggcaaaaggagttaatgatgaaatgtcagaaaggcccttgggagcttttagaaattctcaccagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcag

SEQ ID NO: 5257 - DNA, 472 bp, Homo sapiens
  ENST00000477280
tcagtccagaccctgggcaccccccttttgccaggatcgtccccacccagcctggacacattgactgaactgttttctaggacactggattcaggtcaggtattacctccaccaagaagccttccctaatgttctcagcttggatgagatgctcctcttctgatattctacaggtcctgtttattcctcttctacagcagtgctcacgctgtgtcacaaggatgtactcatatcctgctcatcattgcatgtgaactactggagataactatctatatacatatatcacatctcctaatatgcgaagcacaaagtaggaactcaataaacatcaaacatcccacttccttggcagtggatagcatgaaactgtttattggcactaacctacggatagttaatcagactgattggttctctgtttccttcttctgagatttttacatgtgaataaaagtagatggactgagaa

SEQ ID NO: 5258 - DNA, 5168 bp, Homo sapiens
  ENST00000414851
agcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaagtatagaaagatccacccaacattaaatcagaaatcaagcaaatgcttacccaacaaatatttgagccctcatagctgggtttaagatgactcagtgtgcaaaattattaattccctttttatttctctacctgttgaccactgttgagacaccaaatttggagtgacaggcatcagaggattacaacagggttggaactgacttctttaagcaaaagcaaagggtcttctgtgaccacaatatcgtcatccatatgccttttcacataggatgatgtgttttttgtcactccatggggcctggtctgccattttcccccctttcctttttttgtcatgtttgaaaattaataggtgtacaaatttttgtattgcttttgactttttttagatatgggtgaagaaatctaactggggagaaaaaaagcctcagtgaaatgaattaacttgaaattacaagacaaataagtggttgattattcattatgatcacgaatgttgccaaaacagtcctttagctattctgcatcctggtgaagaaagacagctttcagtacgaaccttcattctgtgagtaggaaaagacatcagatcccattgatgagaaagatgaaaaatgcatctgatttcttaagaagctctaaactctaagtacaataaaatgatattttttatttttccgatatcttgctgctgtgttgctatgcagacaagtgtcttctccacgtgccattttcaaagaaaagtcatttgccaaataattctggtacaattctggtaatgtggttttggatcttaaaaaccaactttctaatggaacaatggtggcataaatattcagaataacaaactgattctgtggtccaaatggttcatctctatctctttttgtacatcagaaaattcaaatgggatttttattttataacttgaaaaaaaaaccttaccattaaactctttaaatatttaagggaaatggctttaaggagttctaatgaaaaaaaattgtcttttttttgtaaatataaatgttaatgaaaatgatttttaataatgccattacactgtagagaaggtagcagattgagtgcaaggtgtgacaaacttgatggatggggctcactttccagacgttattctggagcatatggtaggaagctggagtgcagggacagctggcaggagcagttggccaatcagcagctagtgaacgggaagggagcacgtgactccatcatctagcctttccacgagagtccccaccctacgtgcaacacaagaaaaagacaattcacattctgaagaattcagattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccaggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagaac

SEQ ID NO: 5259 - DNA, 1817 bp, Homo sapiens
  ENST00000420954
cgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacag

SEQ ID NO: 5260 - DNA, 5233 bp, Homo sapiens
  ENST00000613252
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatgtagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 5261 - DNA, 2986 bp, Homo sapiens
  ENST00000619232
atggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggcagcagtgatggttcctgggataaggaaacactgccctcttccccatcccagggacctcaggcctctataacccacccccgcatgcctggagcacgtagccttccacttagtcatcctctcaaccatcttcagcagagccaccttctgccaaatggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaa

SEQ ID NO: 5262 - DNA, 4789 bp, Homo sapiens
  ENST00000611519
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcgatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatgtagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 5263 - DNA, 4627 bp, Homo sapiens
  ENST00000620444
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatgtagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 5264 - DNA, 2028 bp, Homo sapiens
  ENST00000366796
ctgcggagccgggggcggagagaggaggcgcaggaggacccgcgacacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgaggttgcgcgcggcgttcgcggggctgcaggagctgcaggggctgcgagccacgcagcaggagcgggtacggggcgccctggccctgcagcccccgcccgcgcccgccgcgccctgcggcccccacggcctccacggccccgagcagcagctggaggcggcgctggccgcgctgcaggagcagctgtcccggctgagacaacaggacatcggcctgaagacccacctggaccagctggacctgcagattagcaagctgcagctggatgtgggcacagcctcaggggaggccctggacagcgacagcaggcccagctcaggcttttacgagatgagcgacggtggatcctgctccctgtccacgtcctgtgcctccgtctgcagtgaccacatctctccctcgctgggcagtttgttgcctgtggcccaggcccacaaggccaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacagagctgtgcaatgctccaggtgaacttgacatgcatgctccgcctgcaggctgcacctccagttcactgacaggtgtaggttctggtttgagaggaaagtgtggcctctgtggctgtcagctccctttctgctcagtgaacacaagttcaaagacaaaatcatcaggaatttcaagacagcaatgacagagcactacaccaagctgggggctgcattgactgaccagtcacaggctggaagtcgggtcctggccacaggcccagcttcttctcccgatatcatcggcccccctctgcccgccaagtcactctgctttccccacagtgagccagtgggagctgcagagaagtgtccagaaaggactgctggtcagtggaatttcctttacgtggaaagttgaagtgagggagtaatggacgtaagagagaatggtttctccctaacaaatagactggaaattccaatccttctactttctgtgtgtttttctagcatgactgcaagtgctggggccataagcaccatgttcagcagcacccaggaagcaaaagtagttgacagaatgttagtgagcattccttcttgtttttatttttttttaaagccccttctatatttcataatttttgtgattttgggtaaatacaatgttatcataagttaaggaaaagttaatctttttaggctaggaaaagttccagtttacgtgcatatatattattgcaaaatgatgtgaaaatttaatattttttgagataattgatatttttcattcactatgttaataagatgaatcatattaacaaaatgtccattgctaaaccaatcatgcattcataggatgaacaatgtttggttatggtgtttttgtttgtacttttaaatggtacttaaacataattagggagaagatgagctccaaagcacctggcacagctccagcaggctcagctaatggccggtcttctcatttaccaaacccacgtggccaccccgacctcagacgaattttttttacaaagtccagacattcaattatttacaatgtgtctttttaggacactgccagaattaggttgtaaatttttttttaggattgtatcttatgttcatagaagaaattggcctatgaaatttctttcatataatactcacatctggttttcatcccaaagctaaaccagcccataaaagcagctgtgatggttttcttcttcttatatttcaataaatggtatgtaaaagacag

SEQ ID NO: 5265 - DNA, 2942 bp, Homo sapiens
  ENST00000366795
ggaggacccgcgacacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgaggttgcgcgcggcgttcgcggggctgcaggagctgcaggggctgcgagccacgcagcaggagcgggtacggggcgccctggccctgcagcccccgcccgcgcccgccgcgccctgcggcccccacggcctccacggccccgagcagcagctggaggcggcgctggccgcgctgcaggagcagctgtcccggctgagacaacaggacatcggcctgaagacccacctggaccagctggacctgcagattagcaagctgcagctggatgtgggcacagcctcaggggaggccctggacagcgacagcaggcccagctcaggcttttacgagatgagcgacggtggatcctgctccctgtccacgtcctgtgcctccgtctgcagtgaccacatctctccctcgctgggcagtttgttgcctgtggcccaggcccacaaggccaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacaggtgatcttgacagagccctgccggcggacacggggctccagaaagccagcgcggacgccgagctcctcgggctcctctgccagggggtggatatcccgctgcacgtgccggaccccaagtatcggcaggacctggtgtcccagggcggcagggaggtgtacccgtaccccagccccctgcacgccgtggctctacagagccccctgtttgtcctgactaaggaaaccccacagagaggtggcccctcgttccctagggagagccccaggggccccgcaggtctgaacaccatccagactgggccggtcctcgaggctggcccggccagggccagagcttatatcgacaggttgctgcatctgtggggccgggagaccccagcaaagggtagcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactggacaggcctgagggagcccatgcagccccccagccatccctggagtgggaccctgcccactggcccacagggaggggcgggctccagcggaggccagccctggcctgggaggcacccgggcgctcctgttctgagtccaccctctaccccatgcctgtcctcgtccccttggcagtggccccgcaggagagccaccggacctcagcccaagccctgttcccctttgaggcgtcactgctcacctcagtggccaggaggaagcatcgccgctggcagtccaccgtggagatctcggcccgggcccgcctggccagctgtcctgagtctaacctggggccccccaggcccgtggccaggagagcaggtggcccactggcccggggccgtccctcactggtccgccaggacgcctacaccaggagcgactcagagccctccaagcactcggccgagtgtgacccgcggttcccgtcagtcatcccggagaccagcgagggagagtccagtgaccacaccaccaaccgattcggagaccgtgagtccagcagcagcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaagacttccatgcggagctctggtttcagatgccagcagcctccccggccgacctagtgtctcttttcaaggtctgcccaggatgctgcttcccggcatgcaccttgtttccatgttgtcatcctcccatggcttcccctgccctcactcccctctggctggggaagtgtttcccaatcctttgaccattcctccccaaaagcattttaaagaggcggttgcaggactctgagctggaaattgaatttgagtttaaactccacgttaagctgtcagcatacacaaacacccaaattatgccatgatctcaaataaaaggaacattttttttccctcttttaa

SEQ ID NO: 5266 - DNA, 2088 bp, Homo sapiens
  ENST00000610183
acacagctcgggatccgcgcgcgctgggcctccggcgccgctcgtggggttcgggaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacaggtgatcttgacagagccctgccggcggacacggggctccagaaagccagcgcggacgccgagctcctcgggctcctctgccagggggtggatatcccgctgcacgtgccggaccccaagtatcggcaggacctggtgtcccagggcggcagggaggtgtacccgtaccccagccccctgcacgccgtggctctacagagccccctgtttgtcctgactaaggaaaccccacagagaggtggcccctcgttccctagggagagccccaggggccccgcaggtctgaacaccatccagactgggccggtcctcgaggctggcccggccagggccagagcttatatcgacaggttgctgcatctgtggggccgggagaccccagcaaagggtagcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactggacaggcctgagggagcccatgcagccccccagccatccctggagtgggaccctgcccactggcccacagggaggggcgggctccagcggaggccagccctggcctgggaggcacccgggcgctcctgttctgagtccaccctctaccccatgcctgtcctcgtccccttggcagtggccccgcaggagagccaccggacctcagcccaagccctgttcccctttgaggcgtcactgctcacctcagtggccaggaggaagcatcgccgctggcagtccaccgtggagatctcggcccgggcccgcctggccagctgtcctgagtctaacctggggccccccaggcccgtggccaggagagcaggtggcccactggcccggggccgtccctcactggtccgccaggacgcctacaccaggagcgactcagagccctccaagcactcggccgagtgtgacccgcggttcccgtcagtcatcccggagaccagcgagggagagtccagtgaccacaccaccaaccgattcggagaccgtgagtccagcagcagcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaagacttccatgcggagctctgg

SEQ ID NO: 5267 - DNA, 1620 bp, Homo sapiens
  ENST00000607983
acacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactggacaggcctgagggagcccatgcagccccccagccatccctggagtgggaccctgcccactggcccacagggaggggcgggctccagcggaggccagccctggcctgggaggcacccgggcgctcctgttctgagtccaccctctaccccatgcctgtcctcgtccccttggcagtggccccgcaggagagccaccggacctcagcccaagccctgttcccctttgaggcgtcactgctcacctcagtggccaggaggaagcatcgccgctggcagtccaccgtggagatctcggcccgggcccgcctggccagctgtcctgagtctaacctggggccccccaggcccgtggccaggagagcaggtggcccactggcccggggccgtccctcactggtccgccaggacgcctacaccaggagcgactcagagccctccaagcactcggccgagtgtgacccgcggttcccgtcagtcatcccggagaccagcgagggagagtccagtgaccacaccaccaaccgattcggagaccgtgagtccagcagcagcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaagacttccatgcggagctctgg

SEQ ID NO: 5268 - DNA, 5757 bp, Homo sapiens
  ENST00000257215
atcggggccttggggagcccaggatggaggtggcggtcgcggcggcgggccgagccctgcggcgggcgggaggaggtgagcaccaggcccactgagcctctgcagagccaccagccatgcccgggatcgtggtgttccggcggcgctggtctgtgggcagtgatgacctcgtcctaccggccatcttcctctttctcctgcataccacctggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcagtacgtgctctacgtgcgcctggccatcctggtgatcgagttcatctacgccatcgtgggcatcgtctggctcactcagtactacacctcctgcaacgacctcactgccaagaatgtcaccctcggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggcaccgcttagaggagggtcaagccaccagctggtcgcgccggctcaaagtgttcctctgctgcacgcggacgaaggactcccagtcagatgcctactcagaaatcgcctacctctttgcggagttcttccgggaccttgacattgtgccatccgacatcattgctggcctggtgctgctccggcagcggcagcgggccaagcgcaacgccgtgctggacgaggcaaacaatgacatcttggccttcctgtctgggatgccggtgaccagaaacaccaagtacctcgacctcaagaattcacaagagatgctccgctacaaagaggtctgctactacatgctctttgccctggctgcctacgggtggcccatgtacctgatgcggaagcccgcctgcggcctctgccaactggctcggtcctgctcgtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtctatgaaacgcccttctacgtggcggtggaccatgacaagaagaaagtggtgatcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaatggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctgctgctgtgagcaggaggagcccacatactttgccatctggggcgacaacaaggccttcaatgaggtgatcatctcgccagccatgctgcatgagcacctgccctatgtggtcatggaggggctcaacaaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggagcaagtcccagtctgagatgagcctggagggcttctcggaggggcggctgctgtcgccagtggttgcggcggcggcccgccaggacccggtggagctgctgctgctgtctacccaggagcggctggcggcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccgtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagca

SEQ ID NO: 5269 - DNA, 5699 bp, Homo sapiens
  ENST00000540717
ggtcgcggcggcgggccgagccctgcggcgggcgggaggaggtgagcaccaggcccactgagcctctgcagagccaccagccatgcccgggatcgtggtgttccggcggcgctggtctgtgggcagtgatgacctcgtcctaccggccatcttcctctttctcctgcataccacctggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcaccatcctggtgatcgagttcatctacgccatcgtgggcatcgtctggctcactcagtactacacctcctgcaacgacctcactgccaagaatgtcaccctcggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggcaccgcttagaggagggtcaagccaccagctggtcgcgccggctcaaagtgttcctctgctgcacgcggacgaaggactcccagtcagatgcctactcagaaatcgcctacctctttgcggagttcttccgggaccttgacattgtgccatccgacatcattgctggcctggtgctgctccggcagcggcagcgggccaagcgcaacgccgtgctggacgaggcaaacaatgacatcttggccttcctgtctgggatgccggtgaccagaaacaccaagtacctcgacctcaagaattcacaagagatgctccgctacaaagaggtctgctactacatgctctttgccctggctgcctacgggtggcccatgtacctgatgcggaagcccgcctgcggcctctgccaactggctcggtcctgctcgtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtctatgaaacgcccttctacgtggcggtggaccatgacaagaagaaagtggtgatcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaatggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctgctgctgtgagcaggaggagcccacatactttgccatctggggcgacaacaaggccttcaatgaggtgatcatctcgccagccatgctgcatgagcacctgccctatgtggtcatggaggggctcaacaaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggagcaagtcccagtctgagatgagcctggagggcttctcggaggggcggctgctgtcgccagtggttgcggcggcggcccgccaggacccggtggagctgctgctgctgtctacccaggagcggctggcggcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccgtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagc

SEQ ID NO: 5270 - DNA, 1146 bp, Homo sapiens
  ENST00000548052
gaaacccacgcagcctcctggattcttccccgtccctccctctgtcctggggctgtgacctcctccatgttattcacagggtctcagcacgattcatctcaaagcagcgaaacaagcactggcctcagaagaagcaatattaaaacagttacaactcatctagcacacagacacccaactgacaccctgttcctccagtcataacaacaactacagctttgattgaacaagagactgagtttggtaactttctcctaataaaaagatcactgactatggactgcttctggtggggttacgaaaccgcaacctcatgtgcctgcatttcctgaaaagacattttgatgtaggaagggcctggagtcctgctgcttgcgtctctgggatacgggagcaaagagccacgcatcctcatggcccacacaggcgtcacctccagtctctccttggcctcatctccccagcgtcctggaatggcatcgggctggcccagggagcccctgtcctgtgcctctcctttcccctcaggggctgccaggctgaccacccccaccgcaggccaggcctacagtgccccatggaacgtcctgaccctcccccagggtggcagcaggaagaaggaagaaaggggatcctctccagctggccagagagacagaccttcttgtgctcatcaaccctccaagaatgcctgccctccctccttcccccaaggcctgtccacaggggcttgagatcagccagaaaagtcaggcaacttttcagggactgggagcgaggtctcccggccgggcctgggtccagtctctgtgggcagtgcagtgccgagccccacccctcaagccgtgccctgtccatagctccagactttgaccctgcactccagtccgggctggcggacagagggctggaaacaagacgctccagaatcaggagcttcccctcaggaaatagcatcctgtgtccccgcactgcagttgtctggtctctccagcagtttggtacttccgatgaagagcttgtgtctccagaggcaaagtatgggggaagagggaagagagaagaccaagggtccctgagaggggctgtcccctaagccccagtatccaagctcgggctcgaagctggaaggagaattgcctagag

SEQ ID NO: 5271 - DNA, 1345 bp, Homo sapiens
  ENST00000551281
gaaacccacgcagcctcctggattcttccccgtccctccctctgtcctggggctgtgacctcctccatgttattcacagggtctcagcacgattcatctcaaaggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgca

SEQ ID NO: 5272 - DNA, 1756 bp, Homo sapiens
  ENST00000228476
agtgcagtgccgagccccacccctcaagccgtgccctgtccatagctccagactttgaccctgcactccagtccgggctggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacaga

SEQ ID NO: 5273 - DNA, 1576 bp, Homo sapiens
  ENST00000547122
tgcactccagtccgggctggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcgacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaa

SEQ ID NO: 5274 - DNA, 676 bp, Homo sapiens
  ENST00000547768
ggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcg

SEQ ID NO: 5275 - DNA, 2385 bp, Homo sapiens
  ENST00000549215
agaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccgctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtatgctcccatggcaaggaaagtaatgccctcttccactcctcagatggctctggcattttcagggaacagtcatgtctgatctcaagttccacacaggctccatagcaggcaggggcagtggtggctaatatcccctcctctataaatggggaaactgaggctcaatgatggttaaggacctgctcaaggttacatagaggggcagtggtgatgttaatggaggtggtgctgatgagatcaatgttgataatggtgtgactgggagtggggatggtagctggtgctgatggaaatgacactatcaagtatgttagtaccacagcagaggtgacgatctcaaaggcagtgttaacatggctgcactaactgtctcattggcaatattaatcgtgtggcagagatgacagtatcaatggcagtgttaatgatggtggtgaaatggtgaatggggttggttttctaaagtctgtggtcaaataacaggaaaatgtgtacttactggatgtgtacttcgtgtcagacacagcagcaagtccattacatgaatgaccttattaaatctcctctggagctctttgggatagggacagttctccctatgcttcggatgaggaaactggggtgaattaagaggtgaagtcacttgcccaagtcagaccactggtggaaggcagggctgggatgtgatttgaatttgactccaaggctatttccagatatccattttgtggctgccccatcatctcttgcaactgttccagggggtccccaccattccaccccggtgccaagagaagctcaggtggcatctggctttgcccaggactcttcgggaggctcctgagtcttccagggcagaagagcttcatctattctttccactgtccctctcggacctggccaccttctctcttgcctctcctaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaa

SEQ ID NO: 5276 - DNA, 640 bp, Homo sapiens
  ENST00000547166
gagagatccagcctctcaaacatccagcagagagaccataggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagcc

SEQ ID NO: 5277 - DNA, 514 bp, Homo sapiens
  ENST00000546552
gcaaagacaatgttgttgatggagatgacaacattgatggaagtggtgatggaagagttcgttgttggtgttgatggtgatgacagtggcaattgaggtagtgatggtggtggtgttagcagaggtgacaaggttgatggtaatgacctttattcatctcagagccttcattttccttcatccttgaccctcctcatttgtatctaggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctg

SEQ ID NO: 5278 - DNA, 5743 bp, Homo sapiens
  ENST00000358077
cttcagattgcaaaccttcttgccttcaagcctcggctccaacaccagtccggcagaggaacccagtctaatgaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgca

SEQ ID NO: 5279 - DNA, 5759 bp, Homo sapiens
  ENST00000472284
agagcgcgccagcgagcccggagcgcggagctgggaggagcagcgagcgccgcgcagaacccgcagcgccggcctggcagggcagctcggaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgc

SEQ ID NO: 5280 - DNA, 2499 bp, Homo sapiens
  ENST00000469067
agaacccgcagcgccggcctggcagggcagctcggaggtgggtgggccgcgccgccagcccgcttgcagggtccccattggccgcctgccggccgccctccgcccaaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagatgttttacttatttctatcatccgctgtgttgt

SEQ ID NO: 5281 - DNA, 626 bp, Homo sapiens
  ENST00000495182
ccgcccaaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcaggtgcagttagaagaaggtggaagaaaaaagaagttgacactccgattttccacatcatctaactaaaatggatttaaactaactttctctaactattaaatctttcttaggtaagtacagttgtatcccagctctagagttaatgtgctgggtgggtttttacaaataaaaaatctaaaacct

SEQ ID NO: 5282 - DNA, 5892 bp, Homo sapiens
  ENST00000408954
ggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgtt

SEQ ID NO: 5283 - DNA, 579 bp, Homo sapiens
  ENST00000470267
actttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcaggtaaagggggtaccagaagcgtaccctcctggattgtggaaatgcataacgatggggccattgggtggtaaacaaatgcagtttgaatcaggcgtctccctcgccctttctggagatgcgcaaatcatagagaaaagagttactaacccagcggtaaaccgcctgatccaagggcctgggggtggaggagaggcagcagttcagggctagatt

SEQ ID NO: 5284 - DNA, 579 bp, Homo sapiens
  ENST00000496522
ggcgcgggggtgccaccgttgccgcaggctggagagagattgctcccagtgaggcgcgtaccgtctgggcgagggcttcattcttccgcggcgtccctggaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaatt

SEQ ID NO: 5285 - DNA, 548 bp, Homo sapiens
  ENST00000472344
ttcattcttccgcggcgtccctggaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcctgagaacataatgcttttggatagaaatgtccccaaacctcggatcaagatcattgactttgggttggcccataaaattgactttggaaatgaatttaaaaacatatttgggactccagagtttgtcg

SEQ ID NO: 5286 - DNA, 4186 bp, Homo sapiens
  ENST00000491893
gcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatgccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgg

SEQ ID NO: 5287 - DNA, 4334 bp, Homo sapiens
  ENST00000489291
caggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgg

SEQ ID NO: 5288 - DNA, 327 bp, Homo sapiens
  ENST00000463069
tttggaaatgaatttaaaaacatatttgggactccagagtttgtcgctcctgagatagtcaactatgaacctcttggtcttgaggcagatatgtggtaaggagtatgtccttggtgttgtttgctttctgatttatttgactattcttctgacatgtttttttgtttgttttgtgttgtttttaggagtatcggggtaataacctatatcctcctaagtggggcctccccatttcttggagacactaagcaagaaacgttagcaaatgtatccgctgtcaactacgaatttgaggatgaatacttcagtaataccagtgccctagcc

SEQ ID NO: 5289 - DNA, 567 bp, Homo sapiens
  ENST00000475804
atgtgggcttaatactcactgtgtggtggacaccccaacctcaggtccccatcctagccactataggggcatctgcccaaggtgggtgggtggaaccaaaggggacagagtggaaccaggcaggcctgggtgtaggccttgggttctggtctccatagcctgctcacagatgtggctctgaatcaccggctccttttcttctgcagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcc

SEQ ID NO: 5290 - DNA, 853 bp, Homo sapiens
  ENST00000495281
atactcactgtgtggtggacaccccaacctcaggtccccatcctagccactataggggcatctgcccaaggtgggtgggtggaaccaaaggggacagagtggaaccaggcaggcctgggtgtaggccttgggttctggtctccatagcctgctcacagatgtggctctgaatcaccggctccttttcttctgcagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagat

SEQ ID NO: 5291 - DNA, 696 bp, Homo sapiens
  ENST00000494010
gccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacgtgatctctaaaactgcaacagaacagcccctacatgtcccttttctccccagtggcaggggaacagtgacagcttctgcctctcaggggtgacttcaaggactgaggcttgcagagagcactgagagctgggtcgagcacatattatgaggtggtgttcaataaatacttgctgtcatcgtgtatgttcatggtgtagatacagaaacaaatttattcagtgtgaaactgcagcctatgaaaaatctctaaataaaaagcaagcataaaa

SEQ ID NO: 5292 - DNA, 1064 bp, Homo sapiens
  ENST00000466188
cccccgctgtgagagacatgatgtcatggaaggcagggtggtgcagtctaatgatgacactctgcacctcttcaagcgagtagttcacctggtctcagaaccatgtttcttatcaaaaactttagatattcctgggcacccctatgaattcagtacagttccctgggttaccttggcacacaatttgggaaccataggcacaaacaaggcttatgggcttgtcctggtattttcactaattaggatgtcttcaatatctgtcttccatgtcttcttccctggctgtgtctaaatttgaactatggtgcagatcttgctggaactctggaccttgagcccttgactcctgtctctttcaggccagcacagcaggaaacttacttaagttatctttgaagttgtattttgaagctcctcttttaattgcaaagtacttggaaaggttctgcctggctggcctgccccagtggagagcaagtttcaggagaagggagatggctccttcctcctttctggtgggccctgaccccttccttaaccttgtgtctccggaatgtcatcctcagcaactgcgtgagaagaacgacctttggccttttttctctcttcccagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggtgagaagttctgttataggtctgaagttctctacctgtgtttatgtgaaaaagtctcagtctttttccttatttgagaatgagcaaaatgaggctctagacagccaggttttaggaacagtggtccctgtcctgtggtttacatgtcagtcggtataaatgcatcagctccctatctgttttcttctctatttggacttggaaatcatttagcatgtttgcagttgccgtgcctggttttccttctcccactctctctataataaaccactcc

SEQ ID NO: 5293 - DNA, 341 bp, Homo sapiens
  ENST00000497743
acaccgagacgtgctctttgtccacctggcttgcttctcacacctgctatgcttgtttctgcctcagacccacggaattggcgtatggaacacacacagctctccttttcagagaaaagaaactaatgcatttttctccaacaggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctct

SEQ ID NO: 5294 - DNA, 487 bp, Homo sapiens
  ENST00000468482
cattctggtccactttgagcaattttccttgtggcctaggagataggcttatcctgtcgttggccatgctggggccttctagggtcacagtgcacagcaggcgtggggccttcatctctgtggcatgttgcacttgtacctggagagtcggcctgggcatgaggccaacacaccgccctcacctgggcaggagaggcagccaggtaggaggacccaccccctgaagcagttccctctctgcccccagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaa

SEQ ID NO: 5295 - DNA, 5772 bp, Homo sapiens
  ENST00000622514
ggcgcgggggtgccaccgttgccgcaggctggagagagattgctcccagtgaggcgcgtaccgtctgggcgagggcttcattcttccgcggcgtccctggaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatt

SEQ ID NO: 5296 - DNA, 5899 bp, Homo sapiens
  ENST00000469640
agagcgcgccagcgagcccggagcgcggagctgggaggagcagcgagcgccgcgcagaacccgcagcgccggcctggcagggcagctcggaggtgggtgggccgcgccgccagcccgcttgcagggtccccattggccgcctgccggccgccctccgcccaaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatgccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatt

SEQ ID NO: 5297 - DNA, 4835 bp, Homo sapiens
  ENST00000559007
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggagagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctggtgggtaaatgcatgccctcttcttgggcagaattctggggtagcctggagctcagggatgggtgagttccctttcccctcacaaggcaggtgggtgttcactgtttccagccagttctgctggcccagtcctcctcttccctgaaggctgaagtgtgatcttcagaggagtgtgttctggggacctctgggtggtgccgggaggggaccactgatgcagcagcatgaactcctggaggatctcccatcctttcctggtgggccttcagaggggccgctgctgccggctgaccacagacaacccaaaatgtatttctgataacccaaaagctgctttagaatgggagctttacattcttttttccatatttctatttctgctttgtttcagattaccatcatcataatatttagacaatatcttatatttgattactttattgccattttgtatacatttaaagggagtagcttataacagaatatactggtgaagagggtgccctctgcagtcagactaccaggattcaaatctgccacttaccgtgtgaccttgaggaaattacttaacctctctgtgctgatagttcatcatttgtaaaatagggttaataatagttcctaaagattaaataatgacatattcttcctcttcttcttcttctttttttttttttttttgtttgtttagacagagtttcactcttattgcttaggttggagtgcaatggcgcgatctcggctcaccgcaacctctgcctcctggcttcaagcgattctcctgcgtcagcctcctgagtagctgggattacagtcatgcgccaccacacccagctaattttgtatttttagtagagatggggtttctccatgttggtcaggctggtctcgaactcccgacttcaggtgatctgcccgcctcggcctcccaaaatgctgggattacaggcataagccaccatgccaggccaataatgacatattcttaaagcctggcatgtaagtgctcagtaagcgttagcaattgttgttgtttaaaaccttcctgtaggctggcagtagtggttcgtgcctatagtcccagcactttgggtggctgaggcgggaggttcatttaaggccaggagttaaagaccagcccaggcaacaacagtgagaccctgactctacaaaacaaaaacaaacaaacaaacaaaaaaattagccaggtatggtgacaggcacctatagtcctagctactcagggagctgaggtgggaggatcacttgagcccaggagttaaaggctgcagtgcagtggcaccatctcagctcgctgcaacctctgcctcccgggttcaagagattctcctgccttagcctcctgactagctgggattacaggcatgagccaccacgcccagccaaaaagaatgtcagtttctttccaaacttttgttcttgtacaaatattcttaaatagtactctttttactcaaatagcaagcaccatcagctcaaaggttcatcctagaagtggaaaaatgttgggtcccagatatctgttatgcagttttcccaaagggactttccttaaaaaaaaaaaaaaaaagagtaatgataggtccttttgtttaggaagcactggaattgaacattggacaacagatattttaggaatgaagtcactgtggattagtacttcttttaataattttataattacattagatcatcatgacttggatgaaaagacattatggcctcggggtggctgcctcagctctggtttgccatgtaggaactgacagacagtactttatactcatttcctgttttataaaaatggagctcagaagtcatttccctggaaacactggtcagcaaggcggctgaaggtgcagcccatcaaagaagaaggggcatgggatggtggctgtcaagcatggggagtaccttgtggctcacacccatcctccagtctctctaggctgagctcaggagacccagcagccacagaccacccagccaagtggccttgattatatggcagccacaaagggaactagatgtaattttctttattataatttggcctctcctgatgtctggtttcccttagatgccctgctgctttccttcctccaagcagttggtctggcctcgtttcagatccctcccatcccccagcccctggatggatcagcaggcttgctttcaccacccacctccctggcttgtagtcccgtggtccaggtgaatcaacccaggttgcccagcacagccccattcctggcgtctcatgatcctcctgccctggacctctttctcttttttttctccagaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagcca

SEQ ID NO: 5298 - DNA, 1741 bp, Homo sapiens
  ENST00000457488
gaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctga

SEQ ID NO: 5299 - DNA, 539 bp, Homo sapiens
  ENST00000559731
ctttcctgggaaaacagccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctg

SEQ ID NO: 5300 - DNA, 584 bp, Homo sapiens
  ENST00000558064
atgaagaaggtgcacctgaggccggatgaggacctgacagagtttcactcttattgcttaggttggagtgcaatggcgcgatctcggctcaccgcaacctctgcctcctggcttcaagcgattctcctgcgtcagcctcctgagtagctgggattacagtcatgcgccaccacacccagctaattttgtatttttagtagagatggggtttctccatgttggtcaggctggtctcgaactcccgacttcaggtgatctgcccgcctcggcctcccaaaatgctgggattacaggcataagccaccatgccaggccaataatgacatattcttaaagcctggcatgtaagtgctcagtaagcgttagcaattgttgttgtttaaaaccttcctgtaggctggcagtagtggttcgtgcctatagtcccagcactttgggtggctgaggcgggaggttcatttaaggccaggagttaaagaccagcccaggcaacaacagtgagaccctgactctacaaaacaaaaacaaacaaacaaacaaaaaaattagccagatcatcatgacttggatgaaaagacattatg

SEQ ID NO: 5301 - DNA, 537 bp, Homo sapiens
  ENST00000557867
agccttccagctccctgcagcagtcatggggcagggttccccgagtccgtaatccccatttccacctactttcccttagttatttgattccctgtctgtcgtactcagcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctggtgggtaaatgcatgccctcttcttgggcagaattctggggtagcctggagctcag

SEQ ID NO: 5302 - DNA, 8086 bp, Homo sapiens
  ENST00000612884
gaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgtcaaaaggagaaggcagagcccctgaacagcggaagacagagcccacccagctgaagaccaagcacctgagagagtacactctcaaatgccactcaagcatgcctcccaacaactcctatgtcaacttcgagcgttttgcctgtgtggtggaagacgtggctcgggtcgacctgggatgccgtgccctggtggaggcccacgataccatccaggacgatgtggaggccctggtctccatcttcaatgagaaggaagcttggtaccgagaggagaatgagagcgcccggcatgacctgtcccagctcaggtatgagttccgcaaggtggagtcattgaagaagctgctgcgagaagacatccaggccacgggatgtagcctcggaagcatggccaggaaactggaccatctgcaagcccagtttgagattctgaggcaggagctctccgcagacctgcagtggattcaggagctggtgggcagcttccagctggagagtgggagctctgagggcctgggctccacattctaccaggacaccagtgaatccctgtcagagctgctcagcagatcatgcactgaggaatttctggcaggctggaagctctaatcgccagaatccagtcagtgatgcatcccaagaggtttgcagaagcatgttctcatccaccctgctgcggcctccagctagaattatcctgcaggggtgtgtgtctgtagtatagccttccagcccctccacagaatccagaattgctgaggtgccagttaattcttcattctgcacctcccctcaccaatctggttttctgggagggctctggcagggcagccaagctgttaaaacaattagagagtgagtacccctcagggtccccttctgcagagggaggatggctggccctggggaaatgcttgagaattgatttgtgatgaaggatttgttcatatctcactttctgcctacataccttatggactgtagatcttgggtaatatttgagttaattaggaataactaagtcagcatggtgctttcctgctacagaagcagggatttacaatgcatagagaaaataatattgcctttcgtttgcattgatttttcacttaccaagcactcatgtctgacaaatgacctcacttggtccttaaaagaactcagtgagataggaaggtgggtggcattattattattattatttacatgtaactgatgagaaaattgactcagagagggaaaatgatatagtcaatcagtacagatgaaacagaaacccaggatgcccatctctaagatgaggtatatgggagaaagtagtaaggctttgctgtaaatatctaccttaatattaaagtccaggtcccagaggtaaagtaagcaacttcatgtattctgccaggtgtaggtggaatgcatacacctgcagatgattgtcccaggagctctgtcccagaaggcaaagtcattgtccctacccatccctgtctctgtctgaagaccagcctgcaagcaggagagaaggaaggaaggagtcttcccattctccaccctttctcctcttctggctaacggccccaactctgtgtcgagaataaaggccagaaggtcctcaacaggaggttccttttcttatgtacctaggccattgggccttgaaggcctaagaagttccgtgagggtttttgaaaagggcaaacataaagatggggaagcgcaaggccacatggtcgtttcatgacccaaagctttgagcacccctccccaaggattataagatctcatctccctttctctgggggaggggacagtcaaccaactcatgtcaacagagcatggcatatgagcctagtgctgagctagaagcttgtgggtaggggcataacttgtatagttcaaagtgtcttcatggcctcacaaaacatccctatcttagaggcagactaaacgatattcccaatttagagctgaggaaacagggagaggatgggattttcccaaggtcacatcattatggcaaaagtagagaccttctaatgacaagtctgttgctctttctgcttcccctggctgcgccaggctccagaagtttactccctgcttgtgggggcagctcacacctggattcatccatccatttataaattatacttaggcaccaaccaacttccagatgcccggcttgactctggggatacaatgtttagtaaaaataggcctgattcctgtctcacggagtgctcagtccagcgaaggatttgaacattgaccaagaatcacagagagatagagctgcagcttgtgttcatgctgggagagaagcacatagcactgcaggggcctgccgtcagggtctgacagcatcgggggaagcgtcctgaagcagtgacactggaacggaggtcagctaagccaaccagggagagagaagtttcccaacagagccatcataccagagctctgtgatgagaggcggtgtggaaggttgagaatgtgaggactgaaagctggaggggagagaataggaatacagtgcggaaatgaccggagaacaagcaggagcagcagggctttggccatgtggaagagctctgcccttatcccgaaagtcatgagaagccagcgggttccaggtgctggggagggaatgccccgtgaacagctcagacaggaagtggtttaggacaagacaggaaagcttcatctcatgaaaccatttcttcagaatcctgtctccttttctatatgcatgaaggatcatttcaaatatcatatacaatatttgtaacagaaacttacttcatcagctatgagaaaccgtggtgataagatgcatcatcattttatggaccactaagaaaaaaggcccaagatggggcgtctaataggaaactctctctacccccaccacataaagctgtgatgccctcaatgagagggtaaatgagaaatagagccaccatgcagaaagggggagcaaggaaacccatgcatctcaaccttgacactaaatgggggtgaaaaatccttccctgagaacaggagtcccaagccggtggtactcatgcaggtttgctttctgaatttgcactatcagtgtgatccaaaagaacatcaagcagagagtgtaatgtccaacagtctgaggctgggtggccctggatggctggcaaaaacagtactatcctctcccggagcacctgccttctgtccgggccaacagtaagaatatgataccatcatctgggagatgcctcctgacttcagagatccaaaaatgtatatcttggaaccaatgaaagatggcaaaagctccatttcctacatcttaccccagagaattggttcaaatgacctgtctacagtctctccaaggtcttacctgccctgtcacgggaagttgtatacttgtttggtgctgagacactgcaaatattaaatgtccctttggccgtgttaacagaccttgaccttcacacagccaggtttctaaggagaggaagccactgatggggcaacacagggcaagctttttagtgaaggtcaaaatagaatgcaggcccagtgtggtggctcatgcctgtaatcccagcactttgggaggctgaggtgggtggatcacttgaggtcaggagtgtgagaccagcctggccaacatggagaaatcctgtctctactaaagatataaaaattagctgggcatggtggtgggtgcctgtagtcccagctactcaggacactcgggaggctgaggcaggagaatcgcttgaacctggaaggcggaggttgcagtgagccaagatcacgccattgcactccagcctgggtgacagagtgagactctgtctcaaaaaaataaaaaatagaatacagtaaaagagtaaaatgttggcaatgatttgaatggggaaaattgggaaaagggagggagaagtggttgttttagaatcatgatcagctatacacagtgctgagagtcacccatttagttggccgtgagctggactccgaactctaagtggttttccttatagcagtgacatcgtcctctctatgctcatgtccagtcactgtaactgtttctcacttagacgtgtcgtaaacagacctttttctgtacaaagagcttctaaagacaaatgaaagagagttgagaaatgcccccaagtcttttggggaaagcagaggagaccatgaccttcctctgtgtcctggccagctgaagtcccgtccttccatggcattggaacctgatgctgggggagcccgggggcctgtgggatgcagccacaggacctgcttatctctgctccccacacgccctcagctgactttttacaacagtgtggagggctaacaatggcgggaagggctgtgagaatggactgtttcgctggtgcctagaggaaggaaggcttgtgggtgctgctctgtgggcaggcccctctgccattgaggatttttaattcaccaaattgcaatttttttggtgggggagccgcacagagtctcactctgccgcccaggctggagtgcagtggcatgatctcggctcactccaacctctgcctcccaggttcaagcaattctcctgcctcagtctcctgagtagctgggactataggtgcgcagcaccatgcccggctaatttttgtatttttagtagagatgggggtttcaccacattggtcaggctggtctcgaactcctgacctcaggtgatccacccacctcggccttccaaagtgctggaattacaggcgtgagccactgcacccagcccagactgcaaataaaaggtcggcttctgtgctctgttcaaacaccatcctgggctgtttgggaggggaaagtgagtgtatgacatcgccctgaataacaattctcaaggaagctggcaagctggcccttggggaaggcagctgcctgtccctgctgtgaggcaggtgctcacagcctagcattgcctgactgtgtgtcagaaggtggggtgatggtttggtaatcgatgattctgcagctgtgggagcctggcagtgaagggatggagcagaggaataatggcagaaagagctggagtctcccccatgggccccctcccctcccttacaggtgatcatgaagatggtggcttcctacctcactccatcacgcagcacaggtggcccggcccttgctggaggtggctgtgtgcccagctgtcacccctactgtcaatcttctgtaaatgtctgtgggactggatgccttttttccttggtccgtgaaattcctgacccagcagtgggcatgttcacgttgcaaaagggtccagtcccgttgaacaaacactgattgtgctctggctcagggggaggtgacagacaaggacaagataacctcaaataaaagattcagtgtctggggcagatggggacccagccaactagattggaaaagctatggtgagtgataaaatagagcttcctcatctcctagaaatcaaaggagagaggaattctgattgagaaagggtaagagggttgcagagaagagaggccttcccagggacgccgtccccaccagtgaccgccctcctccactcccaagctgtgtcccttgaggaaggcatgagtaaaatctggaaggggggtggggctgagccaagattggggttaggaacttggaacagttgaatggagattaaagagagggagattacacagatttaaaagagtgttttaaactttttgttatggtcccctcagcaggaaaattgccaaaacttgcacagaagtataaggaatgggatagtggattccaggacctatgaccccgctccagcaggaatcaagtcatgcgggtcctctttcattcatctctcccattacttttcttctggggtattttaaagcaaatttcagacttatttaactcataagttctccagcataaatctctgctaaggattttcttcttctttttttctttttttttttttgagacagagtttcactctcgttgcccaggctggagtgcaatggcgcgatcttggctcactgcaacctccatcttccaggttcaagcaattctcctgcctcagcctcctgagtagctgagattacaggcacccaccaccacacccaactagtttttgtatttttagtagagatggggtttcatcatgttggccaggctagtcttgaactcctgacctcaggtgatctgcctgcctcggcctcccgaagtgctgagattacaggcatgagccaccgcacccagccaggactttctttttaatacaaccccatgccattatcacacttgacaaaatcagcaataattccttcatctcatctggattcccattccatcctcacatgtccccaccactcccaacagtgtcccattacagctggtttgttcaaatcaggatccaaacagtccacatgtggcatttggttgctacgtctctcaagtctcttgggttttataacagtacaaaaggaagaacctttgaagcttttcctggggacaaaaaattgctcagaaaactgatggtcccatagaagaataaaaaacagagcgtatccatgtcaagacctaactcagaaatgtgagaccaggccaagcaaggaaaggaatgtttctgcctccttccactggcttgttcactgtagggggcagccttcaggctcacagcctttctgcagctgtccctcccacttaggaggaggcagagcctcaagcctcccacaagccccatgtgctcctttcctgggaaaacaggtgggtgaaggcagcagagcccaggcttcagccatcaaaacatccagcgaaggggaggggtggaggggtgccacctataaaactccattgagggaagggcagcggggaggggtcctgggcaggagagaagtgggtgtgagagtgccctggctttcactggagtaaggggctggagagatggcacagatgggggttggaggtgcaatctgcttgcagttcctaaagaagacctagtatctagagaaaatcgttgtgtggggggtggagttgggggagtcgcctcttcagtaaagccaggattcctttttcatgccttagcagcggctgctgcttcctgcccctgcctgtggatgttggtactgacctggcacaccccactggactttttcaaaggcatttgcagctgcataaacaaaacttgactacccc

SEQ ID NO: 5303 - DNA, 484 bp, Homo sapiens
  ENST00000558076
ttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacggtaagggcacagccatgagttccaatgggcaaagggtccctgctctgtcgccagggttggcctgggcagccagatgcagagggcccatggagaggcctttgctttaaacactgaccctgggcacagatgaaagctagccaggggccccagagggcctgggcttattcgaataggtttatttgcttgctattttaagtttgtgtgtctcaaattcaggtaacttatgaaatgaaaccctcacaaaccacagttgaaaccctttttctttggggccaacttacacagtgttctttgttgaagggta

SEQ ID NO: 5304 - DNA, 909 bp, Homo sapiens
  ENST00000558482
gaggactgcagggccgagcccagcgcaccccgccgcgtcccccgttcccgccgcgcccgccgcgcccgccgcgcccgccgcgcccgccgctcccgccgcgcctgccgcggccgcgaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtgggttcagagctcgatgactccaaacacaccccgggctgctgctgaagagcaggatggagatgggtgtggagcatgagacggcatccagggtctgctgtggaggaggagcataggcgtcatcacctacatcct

SEQ ID NO: 5305 - DNA, 570 bp, Homo sapiens
  ENST00000559897
attgcgtgcagccatacagcagactttagagagaggggtgtcagagaggggctccctacaccagtcctcctgaggggggtagggaactgtgagctggccggatgcaaaacggtatagtacagtggtctcttgtaactcaggctgtagactgagagcaaaatgaacttggttaaaagcaagaaagcctcctccaccacagcagcaccctagacaagctggtggtttctaaaagtggccagtttgccatcgtgaagaagtgccgggagaagagcacggggcttgagtatgcagccaagttcatcaagaagcggcagagccgggcgagccggcgcggtgtgagccgggaggagatcgagcgggagagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctg

SEQ ID NO: 5306 - DNA, 566 bp, Homo sapiens
  ENST00000561162
cccgccgcgcccgccgcgcccgccgcgcccgccgctcccgccgcgcctgccgcggccgcgaccgcggcagctcagcctcccgccgattgtatgttccaggcctcaatgaggagtccaaacatggagccattcaagcagcagaaggtggaggacttttatgacatcggagaggagctggggaggttcttggctggcattctgttgttccagactctccacctgctgctgactttgctgctgctccctgcgtgtttctcactcctgtcatgcccatctagttcccagcgcactgcccacctggctttgtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccaga

SEQ ID NO: 5307 - DNA, 724 bp, Homo sapiens
  ENST00000559306
gaatccagctgctatgtcacgagaactcaagccaccctgtggagaattccacacggagtgcagctgaggcctcccaacaacaaccagcagcaatttgcaaaccatgtgtctcctacagctactggtgtgttttttgcatattggccttccaacatttcttgttgaattatttcaggctcaccttggtcataatgagtggatctggctttacccagggcttcagcctttagcatttcacatgaggaatatccactgagctgggggtcaagaggcctgacctttaatcttggctctgccccaggcaagtgtgaacttgggtaagaacactgaggccaggaaatgttgagtgacgtgtccatactcacatagcatggaagaatcagaggccatggggtcaggacctatgggcttaggatataccggaagaggcctgatttccagtcgagcatttgccaaaaatcagcagcgtgatttgggattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggt

SEQ ID NO: 5308 - DNA, 2603 bp, Homo sapiens
  ENST00000261891
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagcca

SEQ ID NO: 5309 - DNA, 1473 bp, Homo sapiens
  ENST00000558069
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgtcaaaaggagaaggcagagcccctgaacagcggaagacagagcccacccagctgaagaccaagcacctgagagagtacactctcaaatgccactcaagcatgcctcccaacaactcctatgtcaacttcgagcgttttgcctgtgtggtggaagacgtggctcgggtcgacctgggatgccgtgccctggtggaggcccacgataccatccaggacgatgtggaggccctggtctccatcttcaatgagaaggaagcttggtaccgagaggagaatgagagcgcccggcatgacctgtcccagctcaggtatgagttccgcaaggtggagtcattgaagaagctgctgcgagaagacatccaggccacgggatgtagcctcggaagcatggccaggaaactggaccatctgcaagcccagtttgagattctgaggcaggagctctccgcagacctgcagtggattcaggagctggtgggcagcttccagctggagagtgggagctctgagggcctgggctccacattctaccaggacaccagtgaatccctgtcagagctgctcagcagatcatgcactgaggaatttctggcaggctggaagctctaa

SEQ ID NO: 5310 - DNA, 3936 bp, Homo sapiens
  ENST00000270349
agcgctgcggagcgggaggggaggcttcgcggaacgctctcggcgccaggactcgcgtgcaaagcccaggcccgggcggccagaccaagagggaagaagcacagaattcctcaactcccagtgtgcccatgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtgccttcctggtcccctacctgctcttcatggtcattgctgggatgccacttttctacatggagctggccctcggccagttcaacagggaaggggccgctggtgtctggaagatctgccccatactgaaaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgaacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtggtatggatcacagccaccatgccatacgtggtcctcactgccctgctcctgcgtggggtcaccctccctggagccatagacggcatcagagcatacctgagcgttgacttctaccggctctgcgaggcgtctgtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggggtacatggcacagaagcacagtgtgcccatcggggacgtggccaaggacgggccagggctgatcttcatcatctacccggaagccatcgccacgctccctctgtcctcagcctgggccgtggtcttcttcatcatgctgctcaccctgggtatcgacagcgccatgggtggtatggagtcagtgatcaccgggctcatcgatgagttccagctgctgcacagacaccgtgagctcttcacgctcttcatcgtcctggcgaccttcctcctgtccctgttctgcgtcaccaacggtggcatctacgtcttcacgctcctggaccattttgcagccggcacgtccatcctctttggagtgctcatcgaagccatcggagtggcctggttctatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccactcaggcagcctgtgggtccttgcggtgtagggaacggcctgagaggagcgtgtcctatccccggacgcatgcagggcccccacaggagcgtgtcctatccccggacgcatgcagggcccccacaggagcatgtcctatccctggacgcatgcagggcccccacaggagcgtgtactaccccagaacgcatgcagggcccccacaggagcgtgtactaccccaggacgcatgcagggcccccactggagcgtgtactaccccaggacgcatgcagggcccccacaggagcgtgtcctatccccggaccggacgcatgcagggcccccacaggagcgtgtactaccccaggacgcatgcagggcccccacaggagcgtgtactaccccaggatgcatgcagggcccccacaggagcgtgtactaccccaggacgcatgcagggcccccatgcaggcagcctgcagaccacactctgcctggccttgagccgtgacctccaggaagggaccccactggaattttatttctctcaggtgcgtgccacatcaataacaacagtttttatgtttgcgaatggctttttaaaatcatatttacctgtgaatcaaaacaaattcaagaatgcagtatccgcgagcctgcttgctgatattgcagtttttgtttacaagaataattagcaatactgagtgaaggatgttggccaaaagctgctttccatggcacactgccctctgccactgacaggaaagtggatgccatagtttgaattcatgcctcaagtcggtgggcctgcctacgtgctgcccgagggcaggggccgtgcagggccagtcatggctgtcccctgcaagtggacgtgggctccagggactggagtgtaatgctcggtgggagccgtcagcctgtgaactgccaggcagctgcagttagcacagaggatggcttccccattgccttctggggagggacacagaggacggcttccccatcgccttctggccgctgcagtcagcacagagagcggcttccccattgccttctggggagggacacagaggacagcttccccatcgccttctggctgctgcagtcagcacagagagcggcttccccatcgccttctggggaggggctccgtgtagcaacccaggtgttgtccgtgtctgttgaccaatctctattcagcatcgtgtgggtccctaagcacaataaaagacatccacaatggaaaaactgc

SEQ ID NO: 5311 - DNA, 950 bp, Homo sapiens
  ENST00000512002
agactcaagagccatctccaggaccacgttttattttcaagcgagtgctcaaatgctgatgttctgctctgcgctagactttaaggggaccgtcaggatgttggcttcgggcctgactggctgtctggtcggcatgggcactggcagtaaactggcctacgccattgcacccgagaaggaccgtgagctggtggacagaggggaggtgcgccagttcacgctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccac

SEQ ID NO: 5312 - DNA, 556 bp, Homo sapiens
  ENST00000511750
agatgaggccgtgctgttccgagggttattaggatgctgtggtcatgccgtgtgtggatgagtccatgctgttctgagggctatggagcagggcacctctggttctgtggaatcgctgccttgatactccatggggaatcccagatcaatgaacacagacagccccctgcttctcaggctcttccaggccgctggcccgggagggttcacttcctgaggctgcatcttccaccagtcgtctgctgccatttacttcttgaggatggtgttgagtttagaggcctcagtgtggggctgggacaggaagggtgctcaggtcctttgcctgtggcctgcgttctcctgggacagcctctcaccgccctctggctctgcaggtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggg

SEQ ID NO: 5313 - DNA, 3936 bp, Homo sapiens; identical to SEQ ID NO: 5310
  ENST00000621716

SEQ ID NO: 5314 - DNA, 556 bp, Homo sapiens; identical to SEQ ID NO: 5312
  ENST00000626610

SEQ ID NO: 5315 - DNA, 950 bp, Homo sapiens; identical to SEQ ID NO: 5311
  ENST00000630314

SEQ ID NO: 5316 - DNA, 2763 bp, Homo sapiens
  ENST00000393056
ctcaccccagccatgcccgccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacgcctggagtgaccagaaggggcagatccacctggatccccagcaggactaccagctgctgcaggtgcagaggaccccagaaggcctgaccctgcttttcaagaggccctttggcacctgcgaccccaaggattacctcattgaagacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaaggcattttactacccagaggaagccggccttgccttcgggggtccagggtcctccagatatctccgcctggaagttcactaccacaacccactggtgatagaaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggcactgcctccctccgggatccacatcttcgcctctcagctccacacacacctgactgggagaaaggtggtcacagtgctggtccgggacggccgggagtgggagatcgtgaaccaggacaatcactacagccctcacttccaggagatccgcatgttgaagaaggtcgtgtcggtccatccgggagatgtgctcatcacctcctgcacgtacaacacagaagaccgggagctggccacagtggggggcttcgggatcctggaggagatgtgtgtcaactacgtgcactactacccccagacgcagctggagctctgcaagagcgctgtggacgccggcttcctgcagaagtacttccacctcatcaacaggttcaacaacgaggatgtctgcacctgccctcaggcgtccgtgtctcagcagttcacctctgttccctggaactccttcaaccgcgacgtactgaaggccctgtacagcttcgcgcccatctccatgcactgcaacaagtcctcagccgtccgcttccagggtgaatggaacctgcagcccctgcccaaggtcatctccacactggaagagcccaccccacagtgccccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagccctgcacgcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagcctgcacagtggtccagggtccagccctccgccagccctgttccgcctcactgggtgtggcctggcttctgggacaggcaccatgctgggccggggtgtggaatcaccgggaacgcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtggg

SEQ ID NO: 5317 - DNA, 769 bp, Homo sapiens
  ENST00000263611
gccctcagtcgctgggccagcctgcccggccccagcatgcgggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgggatgtccgaccgtggcgagcttgagaacgcagatctcgtggtgctctggaccgatggggacactgcctattttgcggacggcactgtccacttggtctacgggatcctggaggagccgttccggtcactggaggccatcaacggctcgggcctgcagatggggctgcagagggtgcagctcctgaagcccaatatccccgaaccggagttgccctcagacgcgtgcaccatggaggtccaagctcccaatatccagatccccagccaggagaccacgtactggtgctacattaaggagcttccaaagggcttctctcggcaccacattatcaagtacgagcccatcgtcaccaagggcaatgaggcccttgtccaccacatggaagtcttccagtgcgcccccgagatggacagcgtcccccacttcagcgggccctgcgactccaagatgaaacccgaccgcctcaactactgccgccacgtgctggccgcctgggccctgggtgccaagg

SEQ ID NO: 5318 - DNA, 565 bp, Homo sapiens
  ENST00000528138
gtactttcaaaatttccatgggtcctcaggttgattgagagaatcagccccagaatgatcgccagcataaaacaatctatgctggctttctctctgatgcatctccagcagaagagtgatgtacggcctcatggagctctcaggtggaggtagaagtccaggttccccacatggcctccttgacatttgagaaaaatatactgtagttccagctactcagaaggctgcggcaggaggactgagaccaggagctggaagctgtagtgcactgtgatcaggcctgtgaatagacactgcactccagctgggcaacatgctcacagtgtcaaacctgttggagcctggaagcagctgcccaaactcacttagaaagaatgaagagaaataagaaaaagcgaaaactgaagttaggaggagactcaacgtatcaaagtatcgttctgtgtttttgagtaactccagaggccaaagtccacttctccacgtaagatcttcaatcccagaagccctatcatgggatctctctgtgtgtcccacttgtgagagtctaacccaggagttcacc

SEQ ID NO: 5319 - DNA, 542 bp, Homo sapiens
  ENST00000525483
gtactttcaaaatttccatgggtcctcaggttgattgagagaatcagccccagaatgatcgccagcataaaacaatctatgaaaaatatactgtagttccagctactcagaaggctgcggcaggaggactgagaccaggagctggaagctgtagtgcactgtgatcaggcctgtgaatagacactgcactccagctgggcaacatgctcacagtgtcaaacctgttggagcctggaagcagctgcccaaactcacttagaaagaatgaagagaaataagaaaaagcgaaaactgaagttaggaggagactcaacgtatcaaagtatcgttctgtgtttttgagtgtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagct

SEQ ID NO: 5320 - DNA, 420 bp, Homo sapiens
  ENST00000533950
atgggtcctcaggttgattgagagaatcagccccagaatgatcgccagcataaaacaatctatgaaaaatatactgtagttccagctactcagaaggctgcggcaggaggactgagaccaggagctggaagctgtagtgcactgtgatcaggcctgtgaatagacactgcactccagctgggcaacatgctcacagtgtcaaacctgttggagcctggaagcagctgcccaaactcacttagaaagaatgaagagaaataagaaaaagcgaaaactgaagttaggaggagactcaacgtatcaaagtatcgttctgtgtttttgagtccagccaggtccaggcattggggtttagtggccagagctgggattatttcggctccttatgccctgttcttctggatccgtttaactaaaggt

SEQ ID NO: 5321 - DNA, 478 bp, Homo sapiens
  ENST00000528162
aatgggattcggtgcggggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctggccagccaggtccaggcattggggtttagtggccagagctgggattatttcggctccttatgccctgttcttctggatccgtttaactaaaggtgatggctgtggacacctagtgacttatcaggatagtggcacaatgacatctaagaattatcccgggacctaccccaatcacactgtttgcgaaaagacaattacagtaccaaaggggaaaagactgattct

SEQ ID NO: 5322 - DNA, 1979 bp, Homo sapiens
  ENST00000296955
ggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcaggttaactccgttgactgccaaaatagcatccccaacgtgcagccctccgcatctatcagcaggttgccccggatggatctcagagatgaggattggaacaccatgttctttcccaccctaacaacaacaaagggcagtaaattaaagtactctttgtaaggtacagttaccgattaatctagagataaaatattttcttaaaaatatatttcattaaacacctatgctgtctctataaa

SEQ ID NO: 5323 - DNA, 3626 bp, Homo sapiens
  ENST00000338728
cgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcgggcaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaattttcagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaaatggtttactttgtagagtttacatggttttatgcgcacactaattgtaataaactatgccaaaccaaa

SEQ ID NO: 5324 - DNA, 3584 bp, Homo sapiens
  ENST00000533453
caagaagataaaactggaaaacaagagatgaaataacctgaaacaatagatattgtttaataattcagtcttctttttttgttttttggttttccttctgcccaaaaacaataaaatacataacttggagattgtattggactctcaatcctcagtaagaattaatgaccccttcttcttttattccccccttctttttctttaccaggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggtgcagaaaataacacaagtgccaagtgcaggagtagtttcatgactgtaaatgactcgtagttgaaaatacgcttattgtttacataggtgcttctctacctacctccaagttcttgaaatatttgaaaatgtaacaaatctttacattctttctgtgaaaagaatctgtatgcaagttgtaaatatggatatatggattagagagataattcttcaatggtgaaatctttatatggtgtattgtcagtgtgaaaacattaatctgtgaagagatttttaaatgcaactaatataagttggcctgtgagatgatctgaggtttcaaatgagggagaaaaaaatgaaacttgaaattataatagatgttatatttaacaaacttttaaaaatagcctgtaaatattattttcttacaaggaattaggaccacaggatctacacagtcgaacttcaacttttatgttaagagttttgtgatgaacttcaaaaacaataattctaagtggaagacctataaaggaattgtgaataatgaagaaaaggtaagaggtaaccctagaggcaagagaactgagtaggagaacaggcctctatatattttcatcaatgtgtttacattaaatatctcattaataaaagacagtgaggccaagcatggtggttcatgcctgtaatccccaagctttgggaagccaaggcaggaggatcatttgagaccatcctgggcaacatagcaagaccccaccactacaaaaaaaaatttttaattacccaaatgtggtggtgcacacttgtagtcctagatacttggaaggctgaggcaggaagatcacttgagcccaggagttcaaggttacagtgaattatggttgtgctattgtactacagcctgggcaacagagtaaaatcctgtctctaaaataaaataaaacttttaaaaagatgatgatgggctggtcgcgctggctcacgcatataatctcagcactttgggaggctaaggcaggcggatcacccgaggtcaggagttcaagaccagcctggccaacatagtgaaaccccatctctactaaaaatacaaaaattagccaggcgtggtggctggtgcctataatcccagctacttgggaggctgaggcaggagaatcatttgaacctgggaggcggaggttgtagtgagccgagattgcaccattgcactccagcctgggcgacaagagcgagattccatctcaaaaaaaagaaaaagaaaaaaagaaagatggggctttcttggcatccaaatccaagaataagaaatgtgtcaataaaaaccttgagagatctttgtgatttaattcttttctacttcaggaatgaaatacttgtgattttcttgggaagtgaaaattggccatttaaaatggctgcttcagtataagtatggtagatgtttgagttggacatttgtcttgggatcctgttagtgacaatgagaattcggaaggaaatggcaaaagtgagagagctgaagccttgtgctcttgaggttgcttgtctatagcaccagttgaatgtaggaatattaaggtcaaataatacaacaaggcaattttagcttctttatccaaaatgaaatttaaatcagtaaacagttgagcagcaccaccttagttagataaattggcccttgtttgcaaagcctcgtatcttcaatatcaagagtgtctagaaaaatgcaaccgacatagaatccttgccttggtttcatataaccaggtataagtgggatgataaacacctaaaaactcactaatagaatcttaaggtaaacataatttccttctataggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcaggttaactccgttgactgccaaaatagcatccccaacgtgcagccctccgcatctatcagcaggttgccccggatggatctcagagatgaggattggaacaccatgttctttcccaccctaacaacaacaaagggcagtaaattaaagtactctttgtaaggtacagttaccgattaatctagagataaaatattttcttaaaaatatatttcattaaacacctatgctgtctctataaa

SEQ ID NO: 5325 - DNA, 297 bp, Homo sapiens
  ENST00000481630
ctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggttatttcaagctgaagtgtcttcctggagcagttctttgttcttcaaagaggcccatgtaatatgaaactttgaaaggactcaaatataaggtgttgcct

SEQ ID NO: 5326 - DNA, 574 bp, Homo sapiens
  ENST00000424717
aacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgat

SEQ ID NO: 5327 - DNA, 570 bp, Homo sapiens
  ENST00000534777
ttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacac

SEQ ID NO: 5328 - DNA, 387 bp, Homo sapiens
  ENST00000478345
gtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaaaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattgg

SEQ ID NO: 5329 - DNA, 387 bp, Homo sapiens
  ENST00000487076
cactgatttctaatatgcaaaataagattagtatatattcttctagtgaaatcttgtgacctttcttataaatgagataaatttatagataattctacatatttgtatgattttctaaagcacatggcagctgccatctcatttaattctcacatcaaccctatgaggtaagtactattatgatccttatgttatatagggagagagaggcagatacattggcttataaatattcagtaggactttttgtcttgataggaagaagaagaaaggaagtccgtatggatcagcagaggctcagaaaacagactgttggaagcagattaaatatccctttgccagacatcagtcagctgagtttaccatcagctatgataatgagaagga

SEQ ID NO: 5330 - DNA, 10206 bp, Homo sapiens
  ENST00000442544
gtagtacggttccaactcccagctcgcacaccgctggcggacaccccagtaacaagtgagagcgctccaccccgcagtcccccccgcctctcctccctgggtcccctcggctctcggaagaaaaaccaacagcatctccagctctcgcgcggaattgtctcttcaactttacccaaccgacgacaaggaaccagcctcaaccttttaatgcacagcccggccacaggattgccttccatctcctcttggtccctcctggatgtggtttattgatgacttgcgagcccctcagagagctgtcttccctcctctggctccctccgtttccttgagttagttttctaaggttttaccggggctcgggatctcttggaccgaatggaactttttgctgcctgcttttgctgctgattctgtcagtggacaaggaaaaaggcttcgaaggcagcagaggcgcaggggaggtggagaaagaggtggaggaagaggacgaggaggaggaggaagccgaaggggctcggcgcgtgtgtgtgcatgtgtgcatgcgtgtgtgagtgcatgtgtgtgagtgctgccgctgcccgcgacccctggccccgaaggtgttggctgaaatatggagaatagtcttagatgtgtttgggtacccaagctggcttttgtactcttcggagcttccttgttcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaa

SEQ ID NO: 5331 - DNA, 621 bp, Homo sapiens
  ENST00000578080
aaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaa

SEQ ID NO: 5332 - DNA, 549 bp, Homo sapiens
  ENST00000580024
accgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagaaaagaagctgggcacaggggctcatgcctgtaatcccagcactttgggaagccaaggcaggaggattacttgaacccaggagttggagactcacctgggcaacatatagaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgc

SEQ ID NO: 5333 - DNA, 470 bp, Homo sapiens
  ENST00000582875
cgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatctta

SEQ ID NO: 5334 - DNA, 3132 bp, Homo sapiens
  ENST00000304775
gaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtatggtggctcaatctgtcattttgtgttccttgaatcaatcctgtctgttagacatgtcagtcattactttatattcctcttttcacctggaccatacacctgatgaagcagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgcacttctgaataattcacattaagtataattaagctcagcataattttcaagctgctcttgcaccctttcctgagctatggattaaagttctgtagctctacagagaaaacccgtaaa

SEQ ID NO: 5335 - DNA, 576 bp, Homo sapiens
  ENST00000579349
agttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggtctttgttcttagagctcccaagatggcggcaggccactcccaagatggcagcaagccttttattctctgacctggggttcttggcctcatggattccaaggaatggaaacttgggccatgtggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagcca

SEQ ID NO: 5336 - DNA, 546 bp, Homo sapiens
  ENST00000581559
gttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagactaggtgtcatgtgatataactggacccaggagaatgaccccacaactgaaagatttttatgaaggatgatttactattctccaacgtactgacatttttctacagcccaatcattgctggggagaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaa

SEQ ID NO: 5337 - DNA, 518 bp, Homo sapiens
  ENST00000579666
tgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagggcaatgaaaaataggcaacaaatcctgagacatacatattgtaatcttggatcagatatctgcctttgcaatctgtgaacacaaactggcaagcctgaattaagttttcaaaaagttaaatctatgggagattttttggcaagcagtgcccaaatcccttggaataaaagattcatttttgaccactggatctactattatgttaatgcaatcaatacagtttgtactgaccagagcaggcgtttgagattgagtgaccttgcaatcatttccaaaacatgtacagggcactcctctcagccttcttaatggcttt

SEQ ID NO: 5338 - DNA, 322 bp, Homo sapiens
  ENST00000582595
cagcaactttcaaatgggtctctgctgatacaaaacatacttcattccagacaccacaagccagatgagggactttaccaatgtgaggcatctttaggagattctggctcaattattagtcggacagcaaaagttgcagtagcaggtcctacttagtctagtctcatcttggaagactgatcagaataactcattttcatcaataacaggacaattgggcagaatcaccactccttcatgcactctcctagtgagggtctgagaaagttgaaatctgaaagatgtgattttgtcaggtggtgctataaagaattacatctca

SEQ ID NO: 5339 - DNA, 374 bp, Homo sapiens
  ENST00000584710
ctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaa

SEQ ID NO: 5340 - DNA, 505 bp, Homo sapiens
  ENST00000579883
tctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtggtaattattttgtttcatatttgttttataatcccattcattgttttctatttttttcacttgtttttatttcttgaaaaaaaaaaaggttcctgttggagattttttgtgatgtgttaaaaaagttattcaaataaagcaaatgattttctag

SEQ ID NO: 5341 - DNA, 3517 bp, Homo sapiens
  ENST00000581580
aagaagagttactggagcactctctccacccttgcacagagagaaaaggccatgtgagaacagagaaggtgttgtctggaagccagggagaggacccttactagaagccaactttgctggatccttgtgtttacattgaggccacccagataatccaggatattctactcatctcaagatccttaacttcacagctacaaagttcctttcaccagttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaacagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtggagatggagtgggtgaaacaatatgcaatctcttattatccccttttattaccagcatcttcattcagtgtatgaacaggatgatctgagtgaaca

SEQ ID NO: 5342 - DNA, 444 bp, Homo sapiens
  ENST00000578949
ttgcacagagagaaaaggccatgtgagaacagagaaggtgttgtctggaagccagggagaggacccttactagaagccaactttgctgttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctc

SEQ ID NO: 5343 - DNA, 564 bp, Homo sapiens
  ENST00000580146
tactgagtacattctggtaaggtcataaggcagttggaaaggcctcaaaggttaactgaaatgatcaaaggaatgaaatattatagtaagaccagatgagaaattttcagcacagaaaaatgatgggtgaaaagggacacaatcaaattcctgaccatgaaggatattagtaactgaaacatggacttgttcaacaaattcaagaatactgtaggagaactctcctgaagcttgaagttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctg

SEQ ID NO: 5344 - DNA, 750 bp, Homo sapiens
  ENST00000579941
tcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgca

SEQ ID NO: 5345 - DNA, 528 bp, Homo sapiens
  ENST00000579702
actacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtaagggcatctttaaaattcatgcttcatcaagggacagattgactggcgctgtgtaatagcatctaaaccaatgagtactgtccattcaccccaggccaccccaggccattgttgttcttattgttgtttgttcctttgttttcctgcacttaaatatgaagaggaaataaaagctatgaaaaaaaa

SEQ ID NO: 5346 - DNA, 155 bp, Homo sapiens
  ENST00000577224
ttgatttgaaacccaatctttttgactctgaaacatcttccttgtcacaggtggagatggagtgggtgaaacaatatgcaatctcttattatccccttttattaccagcatcttcattcagtgagtatattccaaggacagccctggctgtggtc

SEQ ID NO: 5347 - DNA, 9525 bp, Homo sapiens
  ENST00000412726
tccctgtgctctcttgttccaggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaagttc

SEQ ID NO: 5348 - DNA, 8007 bp, Homo sapiens
  ENST00000360631
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacacttggtgttttgtgttcaatgagaccttcctgcaacctgctccccatgggtggcagttaacaggcccatcagatattgttgaaagaaagcaatatatccatgaatgaaggctaaaattgcaatcctttaccctttgaggcatatttcagttgaaaacaaaaagaaaagaaaatttggcttagagggtcacagagctcccatatgaccaagtctcaagcacattaaatcatggttgtttactggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtgaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaagcacttccaaaattaacattttttgacaattcagatatgaaaagaagcaggggaaaataatacactttactcttttcttgcttaaaggcaaacaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggacttggcgcatttaaacaagtttctgaaaggtttcaatttgactcaagaaaaaaattcaatatttcttttgaaaatactgaatttatcacttgctgcatggatcagatggcataggttaatctttgattttcagaatcctaatgaaataactttcaaacaatttgtgtccttaattaaaggtggaatgagatccaatttttccccctaatccttcagtttaagctgatacatgtaggttaatgtggaatgaaatcatctgtgatatattatgttcatttatcaactgagcttttttgatgttgcctgtttttatgtaaaacatgttcttaaagttaataaaataatagtacttggtgtatgaactactacataatacctta

SEQ ID NO: 5349 - DNA, 4612 bp, Homo sapiens
  ENST00000379893
agccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcaaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacac

SEQ ID NO: 5350 - DNA, 5703 bp, Homo sapiens
  ENST00000255448
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaac

SEQ ID NO: 5351 - DNA, 542 bp, Homo sapiens
  ENST00000477664
gatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataaggtatgagatggtgcagctcaacagtcagtgtttccatggcaacgtgctggcagtctccattaaccagttccttcggtggataaacatgcttttgatttgttatccagtccatatgctgctttatcagtttcattttaatcttgattgagatgccacaccccctcattcctttttttcacccattattcacactgacatttgccagctttctttccattgcacatgctcagtatcaattttccttatggttaaaaggacagtatatttagtgctaatgccaaagcattttcctgacgttgctaattaaaacaatgatttccagtgctcttctgtcccttaacaaatggaagaaca

SEQ ID NO: 5352 - DNA, 578 bp, Homo sapiens
  ENST00000486239
gtcgttcacctaaacagaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgtaagtgactcgcaccatttcctttgttctctcctaacattccttttaaaaatcagttgcagattttctaatgttattgcctccttttgaaagtgttgtgggccaggcgcagtgtctcacgcctgtaatctcagccctttgggaggccgaggtgggtggattgcctgagctcaggagttcgaggacagcttgggcaacatggcaaaaccccatctctaccaaaaaatacaaaaaattagctgggcatagtggcacaagcctgtggtcccagctactcaggaggctgaggtggtaggattgcttgaccctggaaaccagaggtggtagtaagccaagatcgtgccactgcactccaacctgaatgacagagtgagacatcatct

SEQ ID NO: 5353 - DNA, 5247 bp, Homo sapiens
  ENST00000460982
gttggcaagaggcttaattgacacctttgatgtagcctaagacagaacctgcacctcccactgctgcttgggagacgtcagctttacgcagaaaaggcatctgctgatgaatcctgcatctcattcagcctgctctgggagcagccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagagggacctgtaccgccccctctcttcggatgacttggattcagtaggagactcagtgtaaaagaaacaatggagcaatgtatatggtttgtgattgggtgaaggtttcacatttctgaagcaaaagtcttacagcaaaatacacaaaagagttttgcataccttgaaatgataaaagaccaaatcatccaaaagtaaatatgtatgcattttgttttcgtgatgttcaaccttgaaattgagagatttttaaaaatatctcccacatggatttgattggggagagtttgaacacaaaatgctgagatttttgtacagggcctggctctagatgaatttcatacacggacccaatattgagtacaagaacacactaaccatgtggcaatatagagccagaatttctgcagatggagttttcttcttaattataagtagacatagagatataatttttctgtactttctgtaaagcatattaaaacggcactagcaggcatattttttctaaaggttatattgtttttaaaatttgaattgcttggtttttagaggtacttttattacaaaataataaaaatacttgggtagattttttttctccctagacagtagaaaaagctacttactgttttgtgggttagtacatccgagagaaaaagaaaaattatgacaacgacacatctcataaagactctgaagttaggctttaggaacttgccttgtttttgttgtcaagtaaattttattttttaaagttattttattagaaacagtataaatttagcttaagctatatgccaatatgaagaacttggccaatggcattgctatagattgtataattttttcttacaatcatatacataattttttaaatgtgtaaaaactaaagctgggaattttttttttttccatacagacctaaaaaaaattgtgtctggactttttccaagaaatccatttgaaaagcaaaattcacttaaatggtgctgtataaatcaggcccagagtatccaaatctccactctgaaaaattctcaatcttgctggtgttttggaaattttcatatgcaaaactccttttgtgttaaaccaattaagtctatgattataacccattgttaaacattaacctactaattctgctcttctagtcctctattttaaaaattatagtcgtctttgcttaaacataaaataatgattttaaagtctgaatgttaaaaattaatttaatgtgtatggtctattgtatttaagccatatcctagtggtcatttacttttactagttcaaacactaacagtttaagacttgtgaagcatggttttgatattctccaggcttgacatatctcagtaggtgataaattaaaaatgtttgatgccatttggaggcttttacatgattttttttttcaaattttacttgaaaacaatttttaaatgttttattcaagatggagagaaattcagttgtcacacgctgttttaaatgttattgatttatctccctgataaattgttcaactagcaaattttaccatctggtttatagttacgtatgttaccatctcactttacaagtgaataaaatattccaaccaaaagaagaggaagaagaaaaaacgtccaggcaatctaacagcatttgaaaacttagccctataataattagtgcctcattatgctgtctgttggagagaaagacacttctctggcaggttattcaagagctgcaaactgaaacattccatcttgaaagaacagttcataataatacctgttccagacttcaggttttaaaactgtttccaatagaaatgaccagagactcctgctgagatcaaaaggctgctttattttagctgaaacagtaaacatctgtgaggttgcctatgctggtgtctgttttagttatgtctttgtaaaatgcattacttaatacagttgggtccataaaagattagtatgtatttgactaaactgccaaaaatacaaagaaagcagtggaacagttactttaaaactggtggggtcagatggtccagaacaaaaataaattccaataattttaacttccctgcactgtcaatcttatggacaactactgctagaaaggtccaataaatgctatttgttctaagtggtagatattgccaattgatatagagcccatggctttgtttagacagggcaaaaagaaactggacttgtactaattgccgatagatatcatggccaactttccattcaagcagttccaagggaagtgctttccacagcatttaatctcttgaacatatgacttctattaaaggactgttcaggggctatatatatcatttactttttgaaagtaaagtccctcagagattgaaacagcacaccatttatagtctttgagatctctttttatgcaaaacataattctattaaactaaagcagaaataaaaatttcttagcaacaaacacagaagttttcagttcattggtggaacagaattggtgatttataggcacttatgattgagttacttatagaattctttataaaaaaaattcggcaatgaatttttaaattgttctactgagcggggaatgcttcagcaaaagccacgcagttttgtcctaatgataatccttaaatgcgctctgaagacatcgtgctgtagttcaaagttcgatactttttcacttgcactcacttttttcttagatgtagacattgtagaaaaagatattaggaatatttccctgctttcagcattttagaagtgcaaaagttaaaaatatataaagtatgaagttcagtgtgaactcaaaagactatagtgctgaaagccacatggtgtgtttttgtcttgtttaatcaactaggcagggggaaaaatctagacagtttctgtactgccatagaattttaagaagtgtcaggttctctcatctgtatacatccctgtgcgcatatattggctcatctaaatattaagaacccaaaaaacattttctaaaaccatttgaaccagcgctgatgtactatatatatatataccctacataaccagccggggaatttccaacacatgccctgaagatctatacatgattgggctctttttctttctttctttctttctttctttctttcttttttttgcttaaaaacaatgaagtgtgcaagtcagatttcttaatgaaagtgaatgaatatatagaataatattcctgaaaattccacatattttaattcttggactgctaaatttttcatatgtggccatatatctatacaggtgtttgggtgtttatgtaaatttgccaggcttggtgtgtatgtgggtatgcttctgtaagtatctgtgtatgtgtataaaccatcaacagtaaagtatagtatttgtgatacagccttataagttactggctcttgtggaattatacataaaatcttcatgtaataaagtgttactctgtgacatattagttggggcatgtttaaattaaaaagcagtttgctcaactggtatggcaaatggttcaaaatattcagatatactgatttataaaaaaattgaaattcagctaaatccaatattgtgttaactattaaatataagtaacattaatgtttatattgatatatctttgttttcaattattaacaagatcgaatactatgatttttttctattgtgtgtgtatggatggcttgtagtggttgccaatcactatactctaaaaaaatgaaacattgatacagttgcagattgtcaagtataatgttggaacataaatagaagaaaatccagagtatatttgatatgaagtaagtttaataacaaagccagataacctgtaaggcgattctgtatgttctttcaaaactctaaactgttgacaaattttgaatatacttgctgtatgtgtgtatatatctacataaatatatacacacttgaaaatgttaatcgaatgaatttactatatatgcatacatttgctcatttatgcatatttgcattaaccttgctagcatctctatttgtgcatgttagtgacaactgtctttgattgaaatattgcacagaggcatagtgtgaaaaatagagatacactgaattcaatataccaattgcctgatatagcgtgttgtactgtcagttgaaaaatatttgtaattttgtgcctgttatgcatgtggaaaaaagaggaaatcagaggccctcactataatttttaagggtgcatgacatatgatgtctttaaaatgtggttcattttagtagattatggataaattccaagatagtataaatgatgcatgtaatacctgagtgtttgtattatatatggccacaaaatgtttttgaagccagggtagtagatatctaaaagttataggcaaagaagtatgaaagttaactttctgtgatgtgtttttgaggagttgatactcatcagtaagcaaggaattgagtttattttttctaagaactctttactttgaaatatattatgaatgttgtaaatttggataacgtttttataaagaggttacatactttctgctcacagtttcagttgattggatgtgtattctctttaaaaaaaaacattttgtgttaaaacatttgacacagcaatatattttttaaatccatcaactaagtccatcagcagagctttatagagctaagggttgacaaaatgtttcattgaactacccaattttgaaagttcagttactttgtgctgtggtttcattgtaaaatgttgtaccttgtgtttcacactggaccatgttattcctcttgaagttaactttgtgacacttaccaccttagaataactatataataaacaggaaaaactgcc

SEQ ID NO: 5354 - DNA, 2101 bp, Homo sapiens
  ENST00000379892
gcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagagggacctgtaccgccccctctcttcggatgacttggattcagtaggagactcagtgtaaaagaaacaatggagcaatgtatatggtttgtgattgggtgaaggtttcacatttctgaagcaaaagtcttacagcaaaatacacaaaagagttttgcataccttgaaatgataaaagaccaaatcatccaaaagtaaatatgtatgcattttgttttcgtgatgttcaaccttgaaattgagagatttttaaaaatatctcccacatggatttgattggggagagtttgaacacaaaatgctgagatttttgtacagggcctggctctagatgaatttcatacacggacccaatattgagtacaagaacacactaaccatgtggcaatatagagccagaatttctgcagatggagttttcttcttaattataagtagacatagagatataatttttctgtactttctgtaaagcatattaaaacggcactagcaggcatattttttctaaaggttatattgtttttaaaatttgaattgcttggtttttagaggtacttttattacaaaataataaaaatacttgggtagattttttttctccctagacagtagaaaaagctacttactgttttgtgggttagtacatccgagagaaaaagaaaaattatgacaacgacacatctcataaagactctgaagttaggctttaggaacttgccttgtttttgttgtcaagtaaattttattttttaaagttattttattagaaacagtataaatttagcttaagctatatgccaatatgaagaacttggccaatggcattgctatagattgtataattttttcttacaa

SEQ ID NO: 5355 - DNA, 7592 bp, Homo sapiens
  ENST00000615680
acttcattatgattcagtgcaaagtactgacagcactggggcttccggaagggagtggtgtcgggatgggggttgctgttggcaagaggcttaattgacacctttgatgtagcctaagacagaacctgcacctcccactgctgcttgggagacgtcagctttacgcagaaaaggcatctgctgatgaatcctgcatctcattcagcctgctctgggagcagccttagccatccttaaactcatccaaccgattcccatttccgcgggtgcttggcttagtgctgagacgggattccgccgttggtattcaggtccaacactaagactgtgtccatgttagaactcatagaagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtatgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacacttggtgttttgtgttcaatgagaccttcctgcaacctgctccccatgggtggcagttaacaggcccatcagatattgttgaaagaaagcaatatatccatgaatgaaggctaaaattgcaatcctttaccctttgaggcatatttcagttgaaaacaaaaagaaaagaaaatttggcttagagggtcacagagctcccatatgaccaagtctcaagcacattaaatcatggttgtttactggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtgaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaagcacttccaaaattaacattttttgacaattcagatatgaaaagaagcaggggaaaataatacactttactcttttcttgcttaaaggcaaacaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggacttggcgcatttaaacaagtttctgaaaggtttcaatttgactcaagaaaaaaattcaatatttcttttgaaaatactgaatttatcacttgctgcatggatcagatggcataggttaatctttgattttcagaatcctaatgaaataactttcaaacaatttgtgtccttaattaaaggtggaatgagatccaatttttccccctaatccttcagtttaagctgatacatgtaggttaatgtggaatgaaatcatctgtgatatattatgttcatttatcaactgagcttttttgatgttgcctgtttttatgtaaaacatgttcttaaagttaataaaataatagtacttggtgtatgaactactacataataccttagctgaagggtacgctcctcagttcatttgccatattggagtaaaatttcaccttagttcaattcacaattgacacattcagttcacgaaggaatagcccagctgtgttcttagggggaattctctctatgcaaggctttaaaaattagtcatgcggtcagagtgtagctttcccacatgtcctccatagcacagtgtgtatttcatgagcataattcaaaaacagctatttcaaaaatgtcccttgtcatatattacgttcctgcctgggccactgacttggataaatacaaataaaccaaataccattca

SEQ ID NO: 5356 - DNA, 6162 bp, Homo sapiens
  ENST00000324344
cggggcggccgccgccggtgggccgcagatgaagaggaggcggtggcagtggtggaagaagaggcggcggcggcgggggtagggagcctggaaacgcgagcggggatggtaggtggtttggacccgccgggccgccgtcgtttccagaaagggtttgactggaggaacctctggagcagctgttggctggctcctctggctgatggcatgttgaggtacatgggccagcggcagcgagggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgttttaggcactttcttcatttttttggttattttggttatttcctttttggggggatctcccagaatatttgaacctggttacatgttgtgtatctttttttgaagccttcagatagaataagcctgccatttcttgcacaaatttaggttttttttttgtttttttttgtttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaatatttatactcttgaggtaatgagactttgtctgttaaacatttggaggtttctcccttaacctaataccccgctgcgtcccaggtatgtttctcagcctgggcaggaattgcatgttttgagttccattgtgagcagccttacagctctgggctcccatcttaaggattattaaagagttttggcagttggtatttttctaaaactgatattgaccatagggaacatacttggaatttgtttttttttttaaatcctaaacctgacagttcctccttcagaggggcaaatgggaaactttaagatcacccacggtatagtactgctagaaagctgaagggggtcttgggccagatgcctggcttctgttctagctaaataagactcttgaataagtctccaggggtcccagcaggttctgtgggatcagttgtagctgggtacccagactgaggttttaaaaagactgctttttcattaagccagtttgcaactcattttccccggttctggattgggtagtggttgactgagggaaaagccaggctgctcttggccagataaggccctttccatcccagatcagagtgtatcagagaaagctgcacaaaagaggcaggcagcccaggaccctgagtactctggagaaactaggttccttccccaccctttaagaagacattccgtgcattagatgtactagagtggatgtattttgttgttttttaaattaactatttagcctcctcatcccccaccaaaaaagccatttagttattttttggttatattgatccatttgcaaatgagaagccagaaaagggagcagtcagggagggacttacaagttcctttcaagtttgagtacttgatgctcagcaaagatttcaagcttctgcagtagctctgggccaatgcttgactctttcatgaccacaagaaatgcagtttttctgcaaagggatccaaggtgaggtgtgtgtagggtttgaagttatacttctgggaagtgaaaagtcttgttcctttcaacctagaaataggtttgccacttaatgagtgagcagtaagtctgtgtaagaggctgaatgcatgcccctcagataagccagtacactccttgcttagcaacagaacatcagggtgatgtggagaggggcaggatgtggacgccactttggaaatcggcaacatctgagggcaacaacaaacaagtgtgttgggaaataagaaataactcagttttgacaactggctttgtcagcttttgtgatgtttctttagcagtttattggaaagatggtatgagatgacgtgctgcttcattgaattgctctttcccccatctttgccaaatctcaatgtatcgttcttaaccccacctcctgtaaggggctttgctatgcttcagctggttgtctcagcagctgaagtgctgcccacctgtgtgagttgggtccaggaaaccatgtctgcccttctgataagggaagatgaatctagagctgggtgaagatctaaattttaaccaaacccctgggcccaggaaaataacaattgaaaatgtacaaggcagtgttttcaatattaaacttccccaaggaaagcacaaactagtctttttggaaagggagaaaggattaagccacacagtattagtctttgaagcagtactggtctctaggggctggtgccaaaatggagtcccatagtagttacactcgatggcctcatgtactatatactgtgccaaattgtattaaacagtggtggggagttactgggataagaacttgtctaaaagtttacaaaccaaaacagatctgttaggttggtgcaaaagtaagtttttgccatacttaatgtattgccattaagtatggcaaaaaccacaattacttttacaccaacctatgtatttaagaatgtttggtttgccagattccaaatgaggtcttcagtgcagcaaagcccaaaaggtgtagactcagttatgcaattataaggttaaggcgtagaagaaagctgctgctaggtttttgttgcattttacttgactgctctgctgtttttcttgtctctcatgtttggttagctatgacttgagcatcttggtaactgacaaaggtcttccttgggggacttgaacatcttggtaaatgacaggtcttcttggaggactccagcagtatcttgtttaaacgactgaaaggactattaaggttgttgaattgtgttaattgggactcattgaggaaatgcgacattgatcctcctcttattccacagtgtgttttctgatcatataaagaaggttccgaaccatccatccccctcagagtttattcccctggtaagctgtaattgcatatccagtttaaactggactgggactgcatgttggtgaggatcggcaggggttttcccccttttcgaaagatgaaatagattcttgagcactggttgcagaagccaaaatagttcaaatagctttgcataaccattgggttctgcttctgattcaggtgctgggcatcatgtcctccctattcttctcttcttggaaacccagcctatctcataaatacctacttccgccacccatccaacctccctgctcctttcaacacaaatcttggatattgccaaaggaagccattcagcagctgctggggtttttcatccccctgacatgcatacatttgctctgggagaagtgtcttccctctgaccctggtccccagctccgtctgtgcttaattgctcttacctgttgcactaatgaatatgactaggttttaaagggggaatgtgaagcaataggcacatggggcttggatgaattggtcccacagatataccctgccttaagccgctgaggtgatgagtccactgctcatgtgaccctccacctttgtggatccctcttggtttgtgaccagtgtgtctgtttgttgaggttgtacaaacttgacaaaagttaatacttttgtttgtattttctgcactgttgcactctccaaatggccccttgagtatttttattgacttgttacacacatttttgtctttgatgtctacattttttcctttaatgttttttatttggaaggttacctgctgttggatttaataaatttgtttacttgaa

SEQ ID NO: 5357 - DNA, 1996 bp, Homo sapiens
  ENST00000563934
agctgggctgagactgagggagagaagctggaggctgatcttggtccagcagaagctgagcagagctgctgtctttggtctttcaggttggctggctcctctggctgatggcatgttgaggtacatgggccagcggcagcgagggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgttttaggcactttcttcatttttttggttattttggttatttcctttttggggggatctcccagaatatttgaacctggttacatgttgtgtatctttttttgaagccttcagatagaataagcctgccatttcttgcacaaatttaggttttttttttgtttttttttgtttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcat

SEQ ID NO: 5358 - DNA, 9163 bp, Homo sapiens
  ENST00000635795
gctggacaaggcactaggacctagaaggcatctatccaccctggcaggaatttcttgcttggagctcagacaacaaaggcatagagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 5359 - DNA, 9269 bp, Homo sapiens
  ENST00000636035
gaaacctttctagctgttaatgcagcctgtgaatttttttaaaagcatgtaattaatcataggaggttggggggattcactaagcctgagttacatgggagaagctggacaaggcactaggacctagaaggcatctatccaccctggcaggaatttcttgcttggagctcagacaacaaaggcatagagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggtagacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 5360 - DNA, 9405 bp, Homo sapiens
  ENST00000358070
cttatttcttatgaatgtcggatagctgcaccagcttggtggggaaagggtttgatgaatagcacaaagacactggctgttccctggaggctgtccctttaaaggagaatcttagtttattctggggggaggggatgcacacattagagtaggaaagagggcttggaataaaatgaaaacactcccccttcatagtcattgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaat

SEQ ID NO: 5361 - DNA, 6162 bp, Homo sapiens
  ENST00000637570
ggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggtagacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaag

SEQ ID NO: 5362 - DNA, 3019 bp, Homo sapiens
  ENST00000356220
gagattggttttctttctctcagcatctccacccaaccagcagaaaaccgcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggtagacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagc

SEQ ID NO: 5363 - DNA, 2476 bp, Homo sapiens
  ENST00000488120
gattttgtctgcgcaatctttttgctaccccgcaatttcctgttggttataaatgaaacctttctagctgttaatgcagcctgtgaatttttttaaaagcatgtaattaatcataggaggttggggggattcactaagcctgagttacatgggagaagctggacaaggcactaggacctagaaggcatctatccaccctggcaggaatttcttgcttggagctcagacaacaaaggcatagagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaa

SEQ ID NO: 5364 - DNA, 2275 bp, Homo sapiens
  ENST00000637453
atagagagattggttttctttctctcagcatctccacccaaccagcagaaaaccggtgagtggggcttttaagtgattttcaagaagaatgtaacagatgtcaaacgggaaaagcacaaggcaaagcctgctctctctgtctctctgtctcctcttctccttttttgccttattctatccgattttttccctaagcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggtagacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttat

SEQ ID NO: 5365 - DNA, 1320 bp, Homo sapiens
  ENST00000496551
attgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaagga

SEQ ID NO: 5366 - DNA, 602 bp, Homo sapiens
  ENST00000636381
aagcagcagatgggtcacaggcttttttcaaccagttcttttcacaagcagcagattgcagatctggatctggctaatatttaaaatcccttcttttttccttctccttgtccctttttgtttttgcctctcttcacccccatccctttctcccacgctcaggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacacca

SEQ ID NO: 5367 - DNA, 518 bp, Homo sapiens
  ENST00000468911
aatgctgagctcagcataggtcatggtgacattggaaaaaaggcggaattgagcctggcagacccattaggcaccagtctttcttatctcctgtcctcctggtcccttgcaaatatattgatgtggcagtgtgtagcagctgagccctgcttgctttgtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatc

SEQ ID NO: 5368 - DNA, 9231 bp, Homo sapiens
  ENST00000371993
tagagagattggttttctttctctcagcatctccacccaaccagcagaaaaccggtgagtggggcttttaagtgattttcaagaagaatgtaacagatgtcaaacgggaaaagcacaaggcaaagcctgctctctctgtctctctgtctcctcttctccttttttgccttattctatccgattttttccctaagcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttc

SEQ ID NO: 5369 - DNA, 12769 bp, Homo sapiens
  ENST00000395606
agattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatggcagtgggatcaactattctgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatccagtgtttctgtgttttaggacataatttaaaaatatactggattttggccaggtgtggcagctcatgcctgtaatcccagcactttgggaggccaagcagggaagattacttgagcccaagagttgaaaaccaacctggacaacatggtgaaacccagactctacaaaaaatgcaaagattagctgggtgtgttggcagacgcctgtggtcccagctactcaggaggctgaggtcggtaggactgcatgattccgggaggtcaaggcttcagtgagccaagattgcaccactgcactccaccttgggtgacagagctggacactgtatccaaaaaaaaaaagtatgtatttacacacacacacacacacacacacacacactggatgttctaataactgctcttttgtatgtgaagcaagccttaggaatcttacgttttacttctttctgttaaacggcatctgttatcttttgaagtactcacactgaacatgcttcatgctgaatactcacgctaaaggcctcagacatgtaaacattcatccttagtctcttttttctctgttttctcattgggagctgaagcatcctagtctgcagaaaatttaacacaccatattccagctttgcatcacctagacagtagacaaaaggaaaagaaattgtcagtaccgtatcacagctagtgcctctgttcattccagtgatagtacatgagccccttccagtggagtcagatcaagccaaaagattttcctgtaaagtctgtagtagaagacaaatttctttttgatccattagattggtatttctatcttctcagctaattaatgagtaaggcatgtggacaatcgagaaaactaatttgagtgtatgtattaaaattgctcttctaaaaacacgtaaaatattaaagatcaaggcagagcaaaaaagaacgtagcaatcatatactagaaaaagaaactaagttttgctaaactatgtttgggttagttgacctctgtagctattctaaagttttctatcccttatctgtattccgctgtcattcctgtgcctcaagcctctgccaggaatctgatggtactctggctgaacttaaaacataagaatctcaaaggtctcatttagtaaatgttagtgctaagttggtgacagcctgggttatatgctttctctttcagtcttcagtagatgcttgtgatagttttcaaagaactgtaaaatttccgggtctgtacagatttttagagatcatttaatccaaccctgttacagtatcatgtcagcatttaaatagcagtaaaggtcatgaaaagtgaagtgaaaggcagcaaactccatgaaaaactaaatacagtgacaactgagggaagtggtaaagtaaaaaaatattaatgatggaattttaaagctggaaggggcatagagaccattcttttctcaataatattctgcaaatattaacaggtgtcatgtcagaaactaagtttaggaattgacaaattcaaaaatctcccttacagcagggctttgagagcctttgctacactaaatgctctgtgaatctatctggtgctgcgtgggggcctccaaatttatttaaccatattttttaatttggcatttacctagagaaatgctatcacatttaattccttcgttttacagtttcacctcctcatgtgattccttcattttgtaagtgaccgattccaccctatacaatcacatggccaatgaatgacagtcagaattagaacctagtcccctgattcccaaccatgtcttataccagactgtttcccctaatcgataggaaactactcctaaagggcagaaactgcctctctttgtttttgtcccccaacctcccctccacacatacacctctgtaatctgatgctttaagctcagattaaagcatcagcaagctttaatctgacacatggccgtaggcttgagttagcagttggtcccttctttcttccagactctcataagagtaccctatcaggtctggacagacttccgtttatgcctcagattcaaaatacccaggaaaaagaagaagaaatacaaaacaacaaaaagaaaatcaagaaaaaaataagatatccaggaaatattttgttagttttctattctggtgacaaatgcaaacttaaggaaacaagttgcacagtgttaactaatgtttaacattcctttccatagtgtttatgtgggccttttatcaattcatgacaaataggtcacctccaaaactgttccaacataggttaactcagaaatttaaaatttaagtactatcctttttggagactatgagaagagtttttactattgtgttttgttttgttttttggtgtgtgtgtgtatgtatgtgcattccccaaaaatagtccattggcagattgttagggtgaacttttcctctgcctttgtgtttgtataagggcgggtgcatgcttagtattgtctgctaccttatggtttttcatttatatgtaacatggtacaacttgcttcctccccacccaacagttgtcaggatatgttggggaatattctttaggaagattacatctggtcttctgttggagtaagatgaaaaacaagtatgttaacacttgacctttactgctttctcctggaagacattgaatatctaggagcgtcactcataccttcccttgactgtacccacacccactgcggtccctgcttgatctctcaaactttttgtttccctttgagcttcatgacaaaaaattataaccattttctggttctaaggctgccataatcccaactttgccagtaagaagatggagaatttttgctcatagggacatttctcagaagcagctggcaccataactctcctgagacccttgtttcctttctttcagctcctatgacttcttatgttcactctctctaacactactaaatgttgtcaatgactgcaatcacaactctttgaaggcaggctttttcttttcctttgttacctcttattttcaatagccaaagcaggttagttttctcagaatcttcagttttactgaagcatgcattatttctgttttctctctgcagtgatcagtttggatgacagaaactttaaacttttattctggcattgtccagttctgattttctcagctggaactggtgcatgcacatttaataatttcaaagaagtgagaggtaaatgttttctcctgcattatactgtgtttctctagctgaattgatccgtttgttatcttgctcacccgaaacaagtagttgtgccctacagtgagcaacctcagactaggctgttctaagcattctggagaaaataatcctcatcatacagtttgtggtaactcttccaaaaagtttatgaaaattgaaagatctccctatgcatcagctgtggctgccacattccgttctactaggaaggctagtggccacaactccctctagaacatcagaggataaagtacacttatatattagaaaagacaggcatattctgattatggttcattcacaatttctcagtccagggttcagtcagtgaccatagctctgaggtcttcaggctaactccaagaacccgtgccagatagaaacctactcctactacctttccactcaccttcccattcccccacctttgctaccaaagtgactttaaaagtcgagttttaggtgtttgtttttttaacagtctaggaatttcagtgcaattccgtgaggtggtgctgaccttagatgagaaatacgtggccaggctataaggactacatgtagaattgagatgggacagtgtacgtatggactgtgaggggaaagaaaaggtaaatgtgtgaaaggaaagagattggtgcatggtcatgacagtctgacagcttagacatttcagaggcattgtttatgagaaaggggatagggacacataggtctgatgacaaccaaagccctttgatgatgccatctgtcactcaaggctccccacagcctgcccaacctgactctcctgcctgcttctccactgcctaccttcaacaatcaaactatatttttgttacagcaaactacattccatttgcctttaaatgcttgcattttagttattgtactggctacctgtttttgtctgcccagcatcctgtttcccctccttttggatcctctcctagccaattccatgtcttgaatcctttcctgctccttgttaaaattattttctgctttgtgtgagtccctgtaagcaccagcagctcaatcagcactgtctgtaccatggtcaagagatgagtacatgactcaggtcagaccttatttcccaccccataagccacaatgattagacaagaaataggcacagaaccctaactagatagggcagaagccttccataggattttatttgctggccctgaaatgcaggtagccttctatggctgttaaacacaatccagtggcacatggggtgatatgaggatggagccatccatggcaaaactccaccctttcctgtgacatggattatgtgcatctgccatgaaaaggaagcatacacaagaaatgagccaagagttcctggagaactgaagcaagtatcacctccagatcagttgtacttttatttgcttacactattctgaggtgggtctctgtctcttggatccaaaagagttcaaattaataatcatttgacaaaaaattacctccacattcctaatgaagttgtctttgaagataatgtcttgtgatcccctggttgaagttaattactgcttgtgagcccccattaacaacgtgttcctttccccattgcttgcttgtatcagctttgctgaagatctattggctgtaggtgtgcagctttatttctgtgttctctattgtgttccattggtctacgtgtctgttattgtaccagtgccgtgctgttttggttactgtggtcttatagtttgaagccacatctgtgtgatgctgctggctttgttctttctgctttgggttgctttggctattcaggctctttctttggttccatctgaattttagaatagttgttttctaattctgtgaaaatgttccaacctctgtgaaaaatgaggttggtagtttgataggacagcattgattctgtaaattgctttgggcagtatggccatttttaaactatattgattcttccaatccatgaacatggaatgtttttccattttttggtttcatccctgatttctttctgccatgttttgtagttctccttgtagagatctttcacctccttggttaggtgtatttttaagtatttcagtttttttatggctattgtaaatggtattgggttcttgatttgctctcagcttgaacgttattggtgtatagaaatgctcctaatttttgtgcattgattttgtatcctgaaacttgactaaagttgtttatcagtctaggagcttttggcagagtcttcggggttttctaggtataaaatcatatcagcgaagagagctagtttgatttcttttcccagttggatgccttttatttatttctcttgcctgattgctctaagttgaatgggagcgatgagactgggcatcctcttcttattccagttctcagaaggaatagttccagcttttgctcatccagtatgatgtctgtgggttggttgtagatggctcttattattttgagatatgttcctttgatacctagtctgttgaggggttttatcatgagggatgttggattttatccgtattcaataaatggtgttgggataactggctagccctatgcagaagaatgaaactggaccccccacctttcaccgtatatgaaaattaactcaagatggattaaagatttaaatgtaagacctcaaactgtaaaaatcctagaagaaaacctaggaaatacccttatcaacatcagccttggcaaagaacttttggctaagtccccaaaggcaattgcaacaaaacagaaattggcaagtggggacctaattaaagcactctgcacagcaaaagacactatcaacagagtaaacagacaacatacagaattggagaaaatatttgcaaactagacatccaacaaagatctgacatccagaatcaataaggaacttaacaagcaaaaaacaaccccattaaaaaatgggtgaaggacatgaacagacacttctcaaaagaagacatacaagcaatcaacaaacgtgaaaaaatgctcatcactaatcatcagagaaatgcaaatcaaaaccacaataagataccatctcacaccagttagaatggctattgtaaagaagtctaataacatgccagtaaggtttcagagaaaagagaacatttatacactgttgtgggaatgtaaattagttcagtcactgtggaaagcagtttggagatttctcaaataacttaaaacagatctaccattcaacccagcatatgggtttatttcccaaaaggaaataaatccttctaccaaaaacacatatggtcatcacagtgctattcacagtagcaaagacagatcaacgtggctgcccatcaacagtggactggataaagaaaatgtggtacatataaatcatggagtattaggcagccataaaaagaacaaaatcatgtcctttgcagccagccacatggatacagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctc

SEQ ID NO: 5370 - DNA, 5503 bp, Homo sapiens
  ENST00000323669
atgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatatttcagacttcaagaatcgttctttaatctcccacaacttctttttccggaaaatgtaatgcagaataaagataatgccctcgtggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctct

SEQ ID NO: 5371 - DNA, 5603 bp, Homo sapiens
  ENST00000357758
aacgcagctgcggcggctgcgggtctcgtgggggcggagcggtcgccgctgccgccgcagctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctct

SEQ ID NO: 5372 - DNA, 3951 bp, Homo sapiens
  ENST00000556027
gccattccctgtagcaggattaatcatttataaaataaagtccctatccattacttgcttcacataactttttttatgtgaaatagtgttttattgaattaagttccatatctgagttttttagataacatattgattttaaaatctgagtgttataattcttcaaacaaataaagtttgtcttggagaccttcaaattagcttttcctttttgcaatagctgttcatagtttcaagttgagtcgaaaccatgtggactggcacagtgtggatgaagtatatctttatagtgatgcaacaacatctaaaattgcaagaacagttacccaaaaactgggattttctaaaggtaattgttaaatattactagagcttatcaaaattttgggaatctgactttctctcatattcaaaatagacaattcatattctgtttttagtatgttttaagtatattaaatttagtgacagattcctttttaaatgaaacttttattaagttgattgagttgacatgtgttcatcaaggaataattattatatatttagaatgatttgacaaaattaataaatatcttttatacttctaaaagcacaaaagctgttaaacctaaaatgtggcagttgaaatatagtgtcaaggaagatgaggactgaaagttttccattgtatttagtgatctggaggtcactggtgacttagatggattgatggggcagaaaccagatcggcatgggttgaagcgtaagtagaaggtgaagcaatggaagcaatgagaatagacaactcctttttttttttcttcttttatttttaagatggggtctcactctgtctcccaggctggagtacagtggtgtgatcatagcacatcataacctggaactaattcctgggctcaagcaatcctccaaactcagcctcctcagtaactaggattacagggatgcatcactatgcccagctaattttttttatttttttgtagaaacggagtctccttgtgttgtccaggctggtctcaaatttttgggcacaagccatcctctcgccttggtctcccaaagctctggggttacaggcttgaaatacagtgcctggcctgacaactgtttagagaagtttgactaaatgaaagaaaagagagaatgatacctgggaaagatgtgagagcattatcaaaaaataaatgtaaaaagaattttaaagtttgataaaatttttatatcctattttaaaattttaatttcatcaataagtgtgctttgaatatctttttatgtttattagttatatttattttgaattaccttccataactttaacttattttgctatttgaatggttgtctttactttttaattagtaagctctctctgtatacttaagtaattatgtgttatattttgcatatttttttccagtttgccatttcttttttcctgatattttcttattataatatagaagctttaaatttttatatattcagtttgtccttctttccttccatttctttctctttatggtttctggctttggtgttgtgtccagttcactttatatcacagctgatcaatatataccttcttacagtttttatttcctcccccacagccagtgaaattttttcataatattccttttacttcttttttttcttttaacatattgtggaaatgctatttctcagattaaatagtaaacttagaattataatttttctacagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcat

SEQ ID NO: 5373 - DNA, 566 bp, Homo sapiens
  ENST00000555621
gagcaagaagagcagggtagggtttaaccccctagaaaaagggtaatgaaaacgtatgtatagaatctacaggctctgaggaaatatcttcctttctttgacttaaaaaacagaattgtaactaaagagtgttggactaggaaaacattatgaagtggcatttgaaagtgaagtcttaaaaattataactttgtggtcttcaccaatattaacacattttccaactgtttttcatcttctttttcctttgtaattcatcttgactcatcttcattgtgcttgagcattccagtttcttgttctatttttgtcttcccgtctactgtgtcagaatgtactacaaatctaatacaaatgtcccatggaatacaaaagattaagacatttactaactcaccagtccacatggatttcagctatttctgacttgttattgattagcttattgtaatttaaattttaaaaatgcagtccaggccgggtgcggtggtgcacacttgtaatcccagcactttgggaggctgaggtgggtggatcacaaggtcaggagtttcaagaccagcctg

SEQ ID NO: 5374 - DNA, 2722 bp, Homo sapiens
  ENST00000555400
caggattaatgtgagggatagtgggccatcatctgcgtctttatactttagtaagctagcaagcatctaatatttatgaaattataaatacgtgtgtgtatataatctcataccccttcttaggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatgttagttcatacattatttccttaagttgatactgtatctttttaaaacttggggagggcagggaggtataaaatattaatactagctagtcaactctaagatctaaagtgtgccttaactttgaaagaaaaaaatgctttccttctgcttatatttttaagaataatttccaggaaaatgcagttttactttctgcattgatgaattaatagaatattagtaattagggccttgtggcacaaggtcttaaccatcaagcataaaacaaatctctttagggtaagtaccccctgaagtttataaagtagatttttactaatgtgatcttctcagtctcaaaaatcgtgtaattattgctttagatctatgctgtatctggtcttgagactttaaaaactgctataccaaagtcatcctacttctattcaaagcttagaaattttattggatctgctgaatggcttccaattctatcccagctacctagtgtaaagcagatattgaaaaaatgagtaaataaatggatagttatgttggacttagcattatatggatctttaagctttctccggtggacttagaaagtttgaaatgttgagtagttgtgaaacacgaatacacttagtatatatttacttccaagagtctgaacttgaacattatttttaggtgtctagtaaaataaaactaaaacgtcaagtcctattttttcattgacacctataatgaaatataaattctgaaactagctactccttttctgtaactatagcagggagaaaacttttctttctctagaaatttttaaacagattttatttgttacttagagtattgtgttcttactgtgtctgctactctaaattgtaaaatgatggcattcattgccatccatccttagaaagttcaggtgtgacactcctagaggctgaataattcttccacagtcaactccactccaggatgaattattaatagggttgaacattcctacttgggccaacagcatttttaatttaattatatctgtgccagactctggacactgaaaattttataattgcaagtctggaaaattcttttttagactttgatatttgcattaaatatattttaccttctataagagttctcatactatttctgacttgtttccttttctacttaatatcaaaaatgtgattgtgaaaatacaaaattctgtcgtgacatgcagatgtcaagaaaactctaactgctgaagaaaattaatttcaaagaattttgtaaggtagcaggtaaaaagtcatggttctctgtaatgtcattaatgtgcaacagtagtgctagtaaacatcagagtgagggagggagcaagaagagcagggtagggtttaaccccctagaaaaagggtaatgaaaacgtatgtatagaatctacaggctctgagggaataaaacttttttaggttttttttttctgtttaacatagtaatttcaaaataatagagaaacccccagttttttcttccagaacagcagttagtagaggtgcatagctgtattgcatctttttattttgagagcttaacaaaatacatactatgtcattcttacacataaattctttgatagtccgaatggtaaaatagtcaacaagactcaatatgaggtaattatgagtcttacacatattcacatattacacatacttatatattatacatattacacatattcacctctagatatagatataactattaaaattggactattataataagattctgccttttaaatcctattcccaagatttgctttactaattatttggcttgcttcaataatgtaatctgtgtaatcgtcataatttctcgtcgttaagtgctgtcttggctatatcgtgcaaatcataaaacttttcttcattaaatcttctttctg

SEQ ID NO: 5375 - DNA, 558 bp, Homo sapiens
  ENST00000553406
atcagtagaagaaactgaaattaagttgctctgtcaaagctattgagggcttgaggtatatatgccttagacccagtgaagagtcagccacatcacccgggaaagcagttaattatcaaaacacatagaagctgtatattagaggttaaaattatgatagttaagtaactcaatggtttaaaaagttgccattccctgtagcaggattaatcatttataaaataaagtccctatccattacttgcttcacataactttttttatgtgaaatagtgttttattgaattaagttccatatctgagttttttagataacatattgattttaaaatctgagtgttataattcttcaaacaaataaagtttgtcttggagaccttcaaattagcttttcctttttgcaatagctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagact

SEQ ID NO: 5376 - DNA, 599 bp, Homo sapiens
  ENST00000556910
aagtatgtgagggatggtgtttggtcagggacaggatggagattgtgaagggagcacctgcacatgaatggcgcatttgggacaatagctggaaaagagacagggtagatatgcagtgctaaggagtttggcctttatcctgcgagtaatgaggaaccaaacagtagaaggttctttatacttacatgtgattaatgacaatgcaaaagttgagctggagagttggaagcagaatatcagtagaatgctagtgtcataaatcaggtgaaaactggtgggagcctacagaagttaacctaaagaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggatttt

SEQ ID NO: 5377 - DNA, 698 bp, Homo sapiens
  ENST00000557445
cgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatggtaagatcaattgatacatttaatatattctacaaaccaagtaagttgttgataaagtttagagtggtttgtaaatttgacataataattcaggaggtttagaattagaaaatttgatttttttaaacatttgattattctagaatttaaaaattaactactataaatatctgaactatctcaatttttattttaatatgtatggtaagtgtcatgatattaacacagtttactataaatgtacagattgttacaatgcactccctatttaatcttttttagtaattttttagttatcaaaggaaattgaacttaacccaaaaattccttgttgttatatcaagacaagtttcattaatatttcaatgttcttttcctgaagtt

SEQ ID NO: 5378 - DNA, 12339 bp, Homo sapiens
  ENST00000612692
atgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatatttcagacttcaagaatcgttctttaatctcccacaacttctttttccggaaaatgtaatgcagaataaagataatgccctcgtggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatccagtgtttctgtgttttaggacataatttaaaaatatactggattttggccaggtgtggcagctcatgcctgtaatcccagcactttgggaggccaagcagggaagattacttgagcccaagagttgaaaaccaacctggacaacatggtgaaacccagactctacaaaaaatgcaaagattagctgggtgtgttggcagacgcctgtggtcccagctactcaggaggctgaggtcggtaggactgcatgattccgggaggtcaaggcttcagtgagccaagattgcaccactgcactccaccttgggtgacagagctggacactgtatccaaaaaaaaaaagtatgtatttacacacacacacacacacacacacacacactggatgttctaataactgctcttttgtatgtgaagcaagccttaggaatcttacgttttacttctttctgttaaacggcatctgttatcttttgaagtactcacactgaacatgcttcatgctgaatactcacgctaaaggcctcagacatgtaaacattcatccttagtctcttttttctctgttttctcattgggagctgaagcatcctagtctgcagaaaatttaacacaccatattccagctttgcatcacctagacagtagacaaaaggaaaagaaattgtcagtaccgtatcacagctagtgcctctgttcattccagtgatagtacatgagccccttccagtggagtcagatcaagccaaaagattttcctgtaaagtctgtagtagaagacaaatttctttttgatccattagattggtatttctatcttctcagctaattaatgagtaaggcatgtggacaatcgagaaaactaatttgagtgtatgtattaaaattgctcttctaaaaacacgtaaaatattaaagatcaaggcagagcaaaaaagaacgtagcaatcatatactagaaaaagaaactaagttttgctaaactatgtttgggttagttgacctctgtagctattctaaagttttctatcccttatctgtattccgctgtcattcctgtgcctcaagcctctgccaggaatctgatggtactctggctgaacttaaaacataagaatctcaaaggtctcatttagtaaatgttagtgctaagttggtgacagcctgggttatatgctttctctttcagtcttcagtagatgcttgtgatagttttcaaagaactgtaaaatttccgggtctgtacagatttttagagatcatttaatccaaccctgttacagtatcatgtcagcatttaaatagcagtaaaggtcatgaaaagtgaagtgaaaggcagcaaactccatgaaaaactaaatacagtgacaactgagggaagtggtaaagtaaaaaaatattaatgatggaattttaaagctggaaggggcatagagaccattcttttctcaataatattctgcaaatattaacaggtgtcatgtcagaaactaagtttaggaattgacaaattcaaaaatctcccttacagcagggctttgagagcctttgctacactaaatgctctgtgaatctatctggtgctgcgtgggggcctccaaatttatttaaccatattttttaatttggcatttacctagagaaatgctatcacatttaattccttcgttttacagtttcacctcctcatgtgattccttcattttgtaagtgaccgattccaccctatacaatcacatggccaatgaatgacagtcagaattagaacctagtcccctgattcccaaccatgtcttataccagactgtttcccctaatcgataggaaactactcctaaagggcagaaactgcctctctttgtttttgtcccccaacctcccctccacacatacacctctgtaatctgatgctttaagctcagattaaagcatcagcaagctttaatctgacacatggccgtaggcttgagttagcagttggtcccttctttcttccagactctcataagagtaccctatcaggtctggacagacttccgtttatgcctcagattcaaaatacccaggaaaaagaagaagaaatacaaaacaacaaaaagaaaatcaagaaaaaaataagatatccaggaaatattttgttagttttctattctggtgacaaatgcaaacttaaggaaacaagttgcacagtgttaactaatgtttaacattcctttccatagtgtttatgtgggccttttatcaattcatgacaaataggtcacctccaaaactgttccaacataggttaactcagaaatttaaaatttaagtactatcctttttggagactatgagaagagtttttactattgtgttttgttttgttttttggtgtgtgtgtgtatgtatgtgcattccccaaaaatagtccattggcagattgttagggtgaacttttcctctgcctttgtgtttgtataagggcgggtgcatgcttagtattgtctgctaccttatggtttttcatttatatgtaacatggtacaacttgcttcctccccacccaacagttgtcaggatatgttggggaatattctttaggaagattacatctggtcttctgttggagtaagatgaaaaacaagtatgttaacacttgacctttactgctttctcctggaagacattgaatatctaggagcgtcactcataccttcccttgactgtacccacacccactgcggtccctgcttgatctctcaaactttttgtttccctttgagcttcatgacaaaaaattataaccattttctggttctaaggctgccataatcccaactttgccagtaagaagatggagaatttttgctcatagggacatttctcagaagcagctggcaccataactctcctgagacccttgtttcctttctttcagctcctatgacttcttatgttcactctctctaacactactaaatgttgtcaatgactgcaatcacaactctttgaaggcaggctttttcttttcctttgttacctcttattttcaatagccaaagcaggttagttttctcagaatcttcagttttactgaagcatgcattatttctgttttctctctgcagtgatcagtttggatgacagaaactttaaacttttattctggcattgtccagttctgattttctcagctggaactggtgcatgcacatttaataatttcaaagaagtgagaggtaaatgttttctcctgcattatactgtgtttctctagctgaattgatccgtttgttatcttgctcacccgaaacaagtagttgtgccctacagtgagcaacctcagactaggctgttctaagcattctggagaaaataatcctcatcatacagtttgtggtaactcttccaaaaagtttatgaaaattgaaagatctccctatgcatcagctgtggctgccacattccgttctactaggaaggctagtggccacaactccctctagaacatcagaggataaagtacacttatatattagaaaagacaggcatattctgattatggttcattcacaatttctcagtccagggttcagtcagtgaccatagctctgaggtcttcaggctaactccaagaacccgtgccagatagaaacctactcctactacctttccactcaccttcccattcccccacctttgctaccaaagtgactttaaaagtcgagttttaggtgtttgtttttttaacagtctaggaatttcagtgcaattccgtgaggtggtgctgaccttagatgagaaatacgtggccaggctataaggactacatgtagaattgagatgggacagtgtacgtatggactgtgaggggaaagaaaaggtaaatgtgtgaaaggaaagagattggtgcatggtcatgacagtctgacagcttagacatttcagaggcattgtttatgagaaaggggatagggacacataggtctgatgacaaccaaagccctttgatgatgccatctgtcactcaaggctccccacagcctgcccaacctgactctcctgcctgcttctccactgcctaccttcaacaatcaaactatatttttgttacagcaaactacattccatttgcctttaaatgcttgcattttagttattgtactggctacctgtttttgtctgcccagcatcctgtttcccctccttttggatcctctcctagccaattccatgtcttgaatcctttcctgctccttgttaaaattattttctgctttgtgtgagtccctgtaagcaccagcagctcaatcagcactgtctgtaccatggtcaagagatgagtacatgactcaggtcagaccttatttcccaccccataagccacaatgattagacaagaaataggcacagaaccctaactagatagggcagaagccttccataggattttatttgctggccctgaaatgcaggtagccttctatggctgttaaacacaatccagtggcacatggggtgatatgaggatggagccatccatggcaaaactccaccctttcctgtgacatggattatgtgcatctgccatgaaaaggaagcatacacaagaaatgagccaagagttcctggagaactgaagcaagtatcacctccagatcagttgtacttttatttgcttacactattctgaggtgggtctctgtctcttggatccaaaagagttcaaattaataatcatttgacaaaaaattacctccacattcctaatgaagttgtctttgaagataatgtcttgtgatcccctggttgaagttaattactgcttgtgagcccccattaacaacgtgttcctttccccattgcttgcttgtatcagctttgctgaagatctattggctgtaggtgtgcagctttatttctgtgttctctattgtgttccattggtctacgtgtctgttattgtaccagtgccgtgctgttttggttactgtggtcttatagtttgaagccacatctgtgtgatgctgctggctttgttctttctgctttgggttgctttggctattcaggctctttctttggttccatctgaattttagaatagttgttttctaattctgtgaaaatgttccaacctctgtgaaaaatgaggttggtagtttgataggacagcattgattctgtaaattgctttgggcagtatggccatttttaaactatattgattcttccaatccatgaacatggaatgtttttccattttttggtttcatccctgatttctttctgccatgttttgtagttctccttgtagagatctttcacctccttggttaggtgtatttttaagtatttcagtttttttatggctattgtaaatggtattgggttcttgatttgctctcagcttgaacgttattggtgtatagaaatgctcctaatttttgtgcattgattttgtatcctgaaacttgactaaagttgtttatcagtctaggagcttttggcagagtcttcggggttttctaggtataaaatcatatcagcgaagagagctagtttgatttcttttcccagttggatgccttttatttatttctcttgcctgattgctctaagttgaatgggagcgatgagactgggcatcctcttcttattccagttctcagaaggaatagttccagcttttgctcatccagtatgatgtctgtgggttggttgtagatggctcttattattttgagatatgttcctttgatacctagtctgttgaggggttttatcatgagggatgttggattttatccgtattcaataaatggtgttgggataactggctagccctatgcagaagaatgaaactggaccccccacctttcaccgtatatgaaaattaactcaagatggattaaagatttaaatgtaagacctcaaactgtaaaaatcctagaagaaaacctaggaaatacccttatcaacatcagccttggcaaagaacttttggctaagtccccaaaggcaattgcaacaaaacagaaattggcaagtggggacctaattaaagcactctgcacagcaaaagacactatcaacagagtaaacagacaacatacagaattggagaaaatatttgcaaactagacatccaacaaagatctgacatccagaatcaataaggaacttaacaagcaaaaaacaaccccattaaaaaatgggtgaaggacatgaacagacacttctcaaaagaagacatacaagcaatcaacaaacgtgaaaaaatgctcatcactaatcatcagagaaatgcaaatcaaaaccacaataagataccatctcacaccagttagaatggctattgtaaagaagtctaataacatgccagtaaggtttcagagaaaagagaacatttatacactgttgtgggaatgtaaattagttcagtcactgtggaaagcagtttggagatttctcaaataacttaaaacagatctaccattcaacccagcatatgggtttatttcccaaaaggaaataaatccttctaccaaaaacacatatggtcatcacagtgctattcacagtagcaaagacagatcaacgtggctgcccatcaacagtggactggataaagaaaatgtggtacatataaatcatggagtattaggcagccataaaaagaacaaaatcatgtcctttgcagccagccacatggatacagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctc

SEQ ID NO: 5379 - DNA, 872 bp, Homo sapiens
  ENST00000547303
actgagcgtatcatgttaaagatgagcgggtggcagcgacagagccaaaatcagagctggaacctgaggagagagtgttcaagaaggaagtgtatcttcatacatcaccacacctgaaagcagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagccaa

SEQ ID NO: 5380 - DNA, 1067 bp, Homo sapiens
  ENST00000551116
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagcca

SEQ ID NO: 5381 - DNA, 1151 bp, Homo sapiens
  ENST00000623876
ggaagtgtatcttcatacatcaccacacctgaaagcaggtaaacttaacctacccttttccaaaaattttaaacggcaggacagtaaatattttagatgttaaaagtcctatagtctctagcgtgactcttcatctctgccactgtagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggtaagaatgttagccctaaagctaaagggggatgttacctttcccttctcaactaatatctatgttccctttcctcatttccttgaaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatga

SEQ ID NO: 5382 - DNA, 906 bp, Homo sapiens
  ENST00000346473
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatga

SEQ ID NO: 5383 - DNA, 951 bp, Homo sapiens
  ENST00000552740
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcaggtaaacttaacctacccttttccaaaaattttaaacggcaggacagtaaatattttagatgttaaaagtcctatagtctctagcgtgactcttcatctctgccactgtagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatga

SEQ ID NO: 5384 - DNA, 644 bp, Homo sapiens
  ENST00000547526
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggag

SEQ ID NO: 5385 - DNA, 1748 bp, Homo sapiens
  ENST00000307365
gggcgcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaaca

SEQ ID NO: 5386 - DNA, 753 bp, Homo sapiens
  ENST00000473155
cagcaggccaagggggaggtgcgagcgtggacctgggacgggtctgggcggctctcggtggttggcacgggttcgcacacccattcaagcggcaggacgcacttgtcttagcagttctcgctgaccgcgctagctggtgagtgtcccttctgtgtgtgggtcctagagctcgcggtctggtctggtctggtccccagactgacgcctggtcggtccccctcttgtcttacagcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcaggg

SEQ ID NO: 5387 - DNA, 521 bp, Homo sapiens
  ENST00000471240
ggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaaggtgagcggtgggcgggtgccgacgcgactcgaggggccgggaaggtggggaagccccggtgctggaaggggtcagagccgccttggcttcctatcccatcgggacccagattgcttgggggcagggggaattggagtataaggtgagtgaggcggaaactgaggcacggagtgggaaggagcgttggtttcttaaggaaacagcacctcccccg

SEQ ID NO: 5388 - DNA, 2604 bp, Homo sapiens
  ENST00000273990
gctactgcgaggagccggcgcagggtggcccgggaggggtgagcagggtgccgctggctgctggggtctgcaggtcaccgagtccccaggagaggggactcctaagaagccacctgcctgtgtttacccggcagcgagcgcgcaggcccccgcgaactcctggcagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgttaagaaaaaactttactcactgattggaacaacagtgattgaagggtcctaaaaagggaaaatatataaagattatttcatgattgggtagtaaaactattcagctagtcagctaaagtcatttgtagtttgccccacctgccctaaataagaaaccccaaatgtagtctcttttctttctgtgtttcacattcatagcaactgcagctaacaggctgattttctggcctttggagaagtgattcaaaatagtgtagattttctgcatagatcccatttttgtacagaattgaatgggatggaataggtaagcaaaagtagaagcccatttgagttttacatttgattccacaatttggtttcaggtaggcttggtaatagactatataaaccagatttgcctattttgattttcatatggcttttttttctgtaagttttcagaggattttttaaatcacagaatcatactaaatgatatttagcctatcaaaacttccaaaagcccacaccaccagttcctgactcaaatttgaagggtttttagacaggagggtaggattaagtaggtgagtttaattaaagcttaaccctaggtaagagtaaatgagaaatattacggcaataatggaactgcttcactgtttcttggtgacttcctcactctaatgttttaaagaggcaacaaaagcttgtggtgccatttcagtaaccacggtgttgttttagatgcctttataagctcagtttcccctgttcttaagtgttgaatactgtctttaaactagaaaaatgcaaaatattgaactgatatttttgtgtgtagttgattactcttccattgagtgaatgatgaatacctgtgaggataggaaattagttctgagatctagtccctctctgattcacttagtaatctatcctcttttcagtattacatgtgcttaatctcagatgaaccatttcaccatggcagtgttatctcatctctgggcttttctgggaattgaagtatctctccttaaccccaattgtcaagggtagtagctgtatactaccactttgaattattgaaacgggtcaatttacgaagtctgcattggctatggagatatggtttatagtacagcctagagaatgaaactcaccgtccagataaccatgcatgcacccagattttttccaccttggatacctgtcactagggaataataaaggcctgattttttgtcttattccaactaagtagatcattatctctttccttttttatgttaatgagagaatttagcctccactcaacaatgttcaattcagcaaggctttcatatccttgctgtgggtcgtggataaggagcttattcaggtttcctgccctagctattagctccacttcacatgctggagaccggcgtagggacagatgtattcatcctggtgttactgaaaaacaggtgtgatcctgttactgatactataagtgacctaaaatgtcactgttcaaattagccagtgttctaacaaactaaactcttcaaatgcttggaaagatactacaaagccaatctttatagaattgggccaagataaatctatgttgttttgcatggctattgttaagctccaaaggttcactgtgtttctgccgctgtcctggagttgtcaccactgactgggcaaggcttcttgggcatggatgtagaactgttgtccttttcccactaacagttatctttgactctcttgcctgttatgcttacaaaatggtgatggcttatggaaggctgttaaattaatattcctgttaaaggaaattaaagtttgtctatttttgacaataaaacattatatatttttaa

SEQ ID NO: 5389 - DNA, 852 bp, Homo sapiens
  ENST00000502763
aggtgagcgaagctgcggccttggtgggggcagcggggccggggggcgctccgcggggcaggtcgcttccaagttttgcgaactgttgagttagtttcaggttgcggctccgctcccagggctttgtcaaattgagttgcagaggccggttccacccctttggcaaaggagttcctccgctagttcgctcccgggacgccgggcattttaggagcctctgcacgactcgcctgcttttgcaaatccgtctcttctcgcctcattttttccagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgtt

SEQ ID NO: 5390 - DNA, 553 bp, Homo sapiens
  ENST00000513992
gagtgtgaaagcgcggacgctcggggaggggtcgcactgaacaatcaggttcaggctttgacgagtcgtgcacccggaattgcggtcccagtggcccgagatctaccctggaagcaacagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattct

SEQ ID NO: 5391 - DNA, 3749 bp, Homo sapiens
  ENST00000421952
ggccggggtggggtggggcaggatgctggatggcccactgttctccgaggggcctgacagcccccgggagctccaggatgaggagtctggcagctgcctctgggtgcagaagtccaagctattggtgatagaagtgaagactatttcctgtcattatagtcgccgcgccccttctcgacagcccatggacttccaggccagccactgggctcgcgggttccagaaccgcacgtgtgggccgcgcccgggatccccacagccgccgccccgccggccctgggcctccagggtgctgcaggaggcgaccaactggcgggcggggcccctggccgaggtccgagctcgggagcaagagaaaaggaaagcggcgtcgcaggagcgggaggccaaggagaccgagcgaaaaaggcgcaaggctggtggggcccgacggagccccccgggtcgaccccgcccggagccccgcaacgcccctcgggtggcccagctggcagggctccctgctcccttgcggccggagcgcctggcgcctgtggggcgagcgccccgtccatccgcgcagccgcagagcgacccagggtcggcgtgggcggggccctggggaggtcggcggcccgggcccccaagctacgaggctcacctgctgctgagaggttctgccgggaccgccccacgacgccgctgggaccggccgccaccctacgtggctccaccttcttacgaaggcccccataggaccttggggactaagagaggccccgggaactctcaggtgcccacttcatcagccccagctgcgactccagccaggacagacggagggcgcacaaagaagaggctggatcctcggatctaccgggacgtcctcggggcttggggtctccgacaggggcaaggtctcttggggggatccccaggctgtggagcggccagagcaaggccagagcccggcaagggggtcgtggagaaaagcctggggctggctgctgctgacctgaacagtggtagcgacagccatccccaagccaaagctacagggagcgcaggcaccgagatagctcctgcggggtctgcaactgcggctccctgtgccccgcatcccgctcccagatccaggcaccacctcaagggctcgagggaagggaaagaaggagaacagatctggtttcccaaatgctggattccctcccctaaaaagcagccgccccgccatagccagacactccccagaccctgggctcccggaggcaccggatggagagaatctctgggtcttggagagggggcaggaccggagaccctggagggttggaaggcgacccgccgtgcccacaccttgccccgcagttcccagggcctgtcccgtggggaaggcgtctttgtcattgacgccacgtgcgtagtgatacgatcccaatatgttccaaccccccgaacccagcaggtgcagcttttgccctctggggtgacacgcgtggtgggggattcccccagccaatcgaagcccggcaaggaggagggtgaaggggccacggtctttccttccccttgtcaaaagcggctgtcgagcagtcgccttttacaccagcccggcgggggccgcgggggcgaagctgagggcgggaggccgggggactccacactggaggagcgcactttccgcatcttggggctcccggcccccgaagtaaacctgcgggacgcccccacgcagccaggtagcccagagcaccaagccttaggcccagcagcttcgggagcccagggcagagccgaggggtcggaagtggcggtggtccagcggcgcgccggccggggctgggcgcggaccccagggccctacgccggggccctgcgagaagccgtgtcccgtatccgccgccacacagcccctgactcggacacggacgaagctgaggagctcagcgtccatagcggctcctctgatggaagcgacacagaagccccgggcgcctcctggcggaatgagaggaccctgcccgaggttggaaacagttcgccagaggaagatgggaagacagcggaactgagcgacagtgtcggggagatcctagatgtcataagccaaaccgaggaggtcctcttcggggtgagggacatcagagggacccaacagggaaataggaagaggcagtgagaggccccttcttgtatttgtgtccccaacgcatccatccttgggtccactggtccccattcttccccacagacttcctttgcttctcttttccttgtatctttacccatacctgttctcatccttgaaatataaatgaaaggaagggaagcatatgcccattaatgattttgtttcaggagaggtgagaatgagcagatttaattaatgtctgttatgttcagggcacaagggtgagctcttcgcaggggctgatgcactgggtgtggagctgagcagagaggcctaaccaggatcaggcaggagggcagggatggtggcagccataggagggcagggtagggtagggcctctgaggaggagggaaaaagtgaaggagaggctttggacctggtgacagagtgatcagatgacagaggggttcttgggagaagaggcataggtccagcaacaaccaacaaagcagaaggagggctcaccttggtgtcacaagtcttggatttcaatcccaactctgccactgagttgctggttgactgaggccagtcactttccctctccaggcctccaggcctcctggtatataaaatgatggtattctaaggtccatccttccgtctctgacattttgagatctttggaaaggactctatctcatcctcccctcgacaagccaagaatgagaattgggaataagtgaacagagtttgagggtttctgggcggcctccgtgtcacccaaagtcatgatcaattcaggagactgcccaaggcttgcagaagaggtaagggagtgaggcactcctatcccagtctcccaggtttggttgagggctccccaaggcagggcaagatagcggccctgtcactgaccctggcctgtggtggtctgagctggggagggaaggacaccaatgaatcagcttgggacctctttaggccttccccttttcctccaccccgatgctccttagtgatgctctgaggcgtggccacgatctccctcccaggtggtatcgcccacctgaaaaaatcctgagaatttctcccatcttggcctcttccagaaaccggccaggcaaggaaagaggccggtcaccagaagccagcaggcgtggggtgtgatactctctatagccactacagggcgcgcgcaggtcgcggatctccccagttgctaatcccggctctgccactcaatcctatccctagttcccgagcgcgggtcccccgccttgcagtctccagccgtgcggggccgggagcaggcctccggcctcccagacttctagagcccgccgggcccatctttgtactcatccaccccagccggcttgggactcagacaccgaagtctttttttttttctctccgatccttggacacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttcccttta

SEQ ID NO: 5392 - DNA, 2130 bp, Homo sapiens
  ENST00000368924
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcaggttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 5393 - DNA, 1953 bp, Homo sapiens
  ENST00000368923
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcagggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 5394 - DNA, 2021 bp, Homo sapiens
  ENST00000479373
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 5395 - DNA, 656 bp, Homo sapiens
  ENST00000446985
aaacagagaagagctggtgatagctccagagctcagagaaaggaggtctctttacaagaagtctggctctcaaagcctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatc

SEQ ID NO: 5396 - DNA, 718 bp, Homo sapiens
  ENST00000415555
gctccgcgtgtgtgccccaactgtcctggaagcttcaattggaaaactccaaactttaagttttgcttatagcttcagctcaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctat

SEQ ID NO: 5397 - DNA, 10160 bp, Homo sapiens
  ENST00000367922
aaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatatgcctcccaggacccagagggagactgtagcctcatttctgtggagacctttggctggactctcctggctctcccagagactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacacttttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgatatcttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtgtatttccccattcagctttcagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctggtcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcattagaattaaagggacttgaactcaggacctgcagcctattcttctttatccacatgtctctggtagggctacatccagatcacaccatgacttcttatagagcaagagaaaataatattattatatcttcctttgcctaaaatctctccacttattcttttttatgattctgcaccagttcactgggttattctatgattccatattttttttaaaaaaaatcatatttaaaatgaacttacaatgtctgaattttcctggccttgagtcacagaagtaatatgtttcagatggctgcccaatatgtattatcatgtaatacatatctgtgtccttttctgggatgaggaaggcttcaacttctggcactgagaactttgtattacagacacaggtttagtttctagcttagtcatgcctttagagtttagtagcacaaatccatgcaacccaacagaatacatggtgagggcctagtatgtagaatttgaaagtagttcaaatttgaattagaagaatgaagctaggacttatttggaaaaggagatagaaaaaaaatgatcagaaactgtggggccttattacctttgcagtaagttatcttcttcatgatatatgtgaattattttatgtgcagattgtgttttgggattgtcagatctaaacttatattcttgctggctaatgtgctgatagccaggtctgaaacttgatgtgctatccagacacatatgatcagaaaagatctagagtgcaaagaggtgcctgaggagcaaaatgtggttttaatgttgtggaaagatcacttgcaagtatataagactgtataaagaagaggactgtgtgcaagtggggtgaaaaaaaaggatacgtgaatgtgcatatgactgaatagggaggaaggtcagggctagaaaggaggctacataaaaaggggcaatggagaatgcacaggaaagacacaggggaaggtcaagtcgagcaaggtagaaacaggagtagctagagccattgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaagaaaggggaagttcctcttggaaaagatatagcaaccatcggggaatgaccttttcatttcagaagtggatgaggaaggtggtgtgagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaagtatgctgaaacagaacagtgaatgttttgcccaaaactacaaaaataaaagaaaaaaagaaaattgcaatacatggctactaagtctttgatcataagtcgaatttatagacctggaatttgccatcctagtctttcctttttagtaagacttctgtcctctggcagtgcatatggtaggtctctaatgtttcttcatctccaggaagatgcagatccttatttttgctgggaaatccttctaaatagaaatgtaacatttttataaaaacagattaatgtgtttttcacttagtaaatgttttcaagagctgaattgagaaggaaagagactggagtggttaatggtgatttgatttctggcattctgagttttctgctacaattagctgcattacttggtgccaaagagcagtggggaattgttgagttgctgtatcctttaaaaaaaaacaaaaaacttgttattttgaaagaacttaaggctcacaagatgttacaaaaatagtagagtggccttaccctagatccagttttccccatttataacatttcacttagtccattttcggaaccagaaaattaacattggcataatgctattaactaaactacagaccttttttcaatttcgccagtttttccacacatattcatttagttgctggatacttttaattcttgctgatttgtaaactggccttgcttggatacaacaggaaagatactatctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttcatagcttgttgtctagaaaaccaggtagcaggatattctagatgcttcctgctgcttctacgtgagtaggattagcactggggacaaaataaggagtttagagtaaaccagtatttcagtcaagagttagttggcacttagttaatggcactggaaatagcttgtggagagaatagaatacaatggtatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactgatggatctccctttctgtataaacagtgccagttctgggctttgtaacctttgctctttatagtctttcattcctggggaagtgatggggcatgggcccagagctggggtgtatgtggtatggacacctgtttgtggggctttccagcaaaggattatttaaatagacctctaacatatgagttgactgtttattgggaagaaagcatcttggtctctgacatatccaaacatacgagacactgggattttacgtcctcacattaattagtccagttctggggaatccagtctagaattaactggtgatcccttatcgttatggttacagacttgtcttgtttgatacacagaaatcctttttaaatccaaatatagtctgtctcagactacctgcacatgcacaaaccaaaaaaaactatgaaaaccagaatttagactcagtcattatactagagattagaatgaaacgaccccaaacaacccatttcttacctggtctctgagaataagtttatacttttagttttctgagaatatttctcagaatatgtgagttttctgagcacatttttcagcatggggtatggtagataaatcacagggccaaggtttggcagggatagatgggatcattgtgtaccctattgttcttctgatttccaggagaacagaatgagcccatgcaaaacataaacttatgatgattaaaaaaaacacacctatccattcactcatcaataaaaacatattatgatggttatcaagctgtgtcctatgagtgataaaatatttgtaaaatataaaattaaatggcatctattttgaa

SEQ ID NO: 5398 - DNA, 3096 bp, Homo sapiens
  ENST00000367921
catcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacact

SEQ ID NO: 5399 - DNA, 558 bp, Homo sapiens
  ENST00000458105
cttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggtgtcaagggagaaacctcagcaagcatcaggtaggtatgacacgcctgctcccagttcattgcatctatttttagtctctgctaacctcctgagaagtccacattctctttctagatttggtctgccgctgctcctggcctaatttgagcaactctcctttgctactgaatataagatgtgtggagggacccacatacca

SEQ ID NO: 5400 - DNA, 693 bp, Homo sapiens
  ENST00000433757
catctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggtgagttgattctttgattcccttatagctcgaagaaggtggttggataaaaatgatcagtagaacaaagagtcccttccagaggtggattcacaacagaatgtctcttccatttgtctctccttgcattgtcctctggatttcagtattgggtcaacctaatctttgtcaaatagctgtggagttcc

SEQ ID NO: 5401 - DNA, 2709 bp, Homo sapiens
  ENST00000360160
agaggggtctggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaa

SEQ ID NO: 5402 - DNA, 1049 bp, Homo sapiens
  ENST00000454054
ggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacag

SEQ ID NO: 5403 - DNA, 4445 bp, Homo sapiens
  ENST00000336079
gcgtaggctaaccagtgcgcttaatagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 5404 - DNA, 528 bp, Homo sapiens
  ENST00000493363
gcttaatagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggtacgtctttaaggcaactttgtagacctaacctttagcagctaatcaaagcctagggaagaaagtaactttaggaggtctataaatgttttttgtcccctcctgtgcctctttcagactgtctttaagaactagcactttctgtttttggaacagtttgtataatgttgaatgatggatagttgtttcctttggcaaactgagcccaaagaatctgagttttgtatagtggtttatctgtttgtaaacatttatgttttgaaatttgaaaccagtgtatttgtggaaa

SEQ ID NO: 5405 - DNA, 792 bp, Homo sapiens
  ENST00000440554
gaaggatggctgccgcgtgcttctcttgaccctgtagaaataatggaaattggacgcccgcggaaagacacctggaagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaag

SEQ ID NO: 5406 - DNA, 507 bp, Homo sapiens
  ENST00000469101
attcaactgatacccaagtacgtttctagagcgatgataatctaacatgggctaaatcgtgtacttctgattgcttgtgctattcagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcagtaagtttttgaaatgtatgttaattgttatgaaatttattgcttagtataacatgtatgtaataattgtttgatttcagagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacat

SEQ ID NO: 5407 - DNA, 572 bp, Homo sapiens
  ENST00000472510
agaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacaccttattttcatttttttttttttacccctttcacccactgaaaataagtttgtagatgtaatctgcaaattataaagagaaagtgatgaatttttaaaaacaattgaagttttgggttatgaatttaaaattatatttatgttttaggaaaatggaaggtatg

SEQ ID NO: 5408 - DNA, 621 bp, Homo sapiens
  ENST00000463199
tgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaagtaaaatattcattttagtgattattgcttttcttatttgtcaaatgatgttgttatagtcactgacatgttctttgcttaaagttttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaa

SEQ ID NO: 5409 - DNA, 517 bp, Homo sapiens
  ENST00000495478
gtatatgtcaaattgtgacactgcaatagttactacttgagttactatattagtgcaattaattacacaactatatatagtaattagtttctcagatctaataatccagtatcaactgagggttttcgtaataggtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtacta

SEQ ID NO: 5410 - DNA, 1830 bp, Homo sapiens
  ENST00000247003
gtcggcgcgcgccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcc

SEQ ID NO: 5411 - DNA, 583 bp, Homo sapiens
  ENST00000599981
aaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatgggtacgggagctgggaggcgggggaagccccagcatgggaccctagcagctttggaccacctgcccagccctgcctctcatgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgc

SEQ ID NO: 5412 - DNA, 772 bp, Homo sapiens
  ENST00000599373
aaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatgggtacgggagctgggaggcgggggaagccccagcatgggaccctagcagctttggaccacctgcccagccctgcctctcatgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgcccctgcagacctcaggagctgggctcggagcctccaggcccaatgtcagagcctggggcaccatctcatccatttaggaaacgtatgtccgttagactgtccagtaaaacgct

SEQ ID NO: 5413 - DNA, 721 bp, Homo sapiens
  ENST00000594021
aaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcaca

SEQ ID NO: 5414 - DNA, 1882 bp, Homo sapiens
  ENST00000595858
caagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccgtggagctgaccagccacctctgcctccaggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttc

SEQ ID NO: 5415 - DNA, 557 bp, Homo sapiens
  ENST00000593361
aagcggccacaaggatggcaggcttcgcggagctcgggctgtcatcgtggctcgtggaacaatgtcggcagctgggtttgaagcagcccacgcccgtgcagctcggctgcatccccgccatcctggaggaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgca

SEQ ID NO: 5416 - DNA, 753 bp, Homo sapiens
  ENST00000598972
agcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccg

SEQ ID NO: 5417 - DNA, 1691 bp, Homo sapiens
  ENST00000602113
aaggatggcaggcttcgcggagctcgggctgtcatcgtggctcgtggaacaatgtcggcagctgggtttgaagcagcccacgcccgtgcagctcggctgcatccccgccatcctggaggaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttga

SEQ ID NO: 5418 - DNA, 1550 bp, Homo sapiens
  ENST00000601803
gggtacgggagctgggaggcgggggaagccccagcatgggaccctagcagctttggaccacctgcccagccctgcctctcatgctctgtcccccagacatggtggcccaggcgctggagctctctcggaaaccacacgtggtcatcgccacgccggggcgcctggcagatcacctgcgcagctccaacacttttagtataaagaagatccgcttcctggtgagttcgccccgcccctgcagacctcaggagctgggctcggagcctccaggcccaatgtcagagcctggggcaccatctcatccatttaggaaacgtatgtccgttagactgtccagtaaaacgctaggaacagtgacaaggaccgttcaaggaccaacaagagggggcccagtcctagcaatgttattcgggggtagggccttgctgagacttgggtgaggggcaggcctcccttggaaggagggtactccagggcctagggtccatgtccatgcctctcaaagaggcctgcttcaggggtggccaagacccggggccatggacggcaccctcacccctgcccccattggcacggcaggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggtgagcagcccccagtctcctgccaagggcactccctcttttactacaaggccccacagatgagaaggctggcctcaggcatgtcaggcagccctagcatccctgctgagtgaccctgggtgagtccttgcctcggtttccccacatggacagtggagctgaccagccacctctgcctccaggggcctggacatccctacggtacaggtggtcatcaaccacaacacccccgggctccccaagatctacatccaccgagtcggccggacggcccgtgcaggtgagcagtggagggggaggccgagccttgggcctctgtccctccagcctgcccagcaaattcaggtggtaggacgtgggtagggtgcagcccacagatgagagctactcagggccatgtttgcaagttggggagttgtcctttctaaagcaaaggtgaatcccagctactcgggaggctgaggcaagaagatcacttgaacccgggag

SEQ ID NO: 5419 - DNA, 633 bp, Homo sapiens
  ENST00000599156
gatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccgatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagag

SEQ ID NO: 5420 - DNA, 342 bp, Homo sapiens
  ENST00000601772
gactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagcaaaggtgaatcccagctactcgggaggctgaggcaagaagatcacttgaacccgg

SEQ ID NO: 5421 - DNA, 771 bp, Homo sapiens
  ENST00000598277
aagtccagcatctaccggatcctgatcgcaacagacgtggcctcccggtgagcagcccccagtctcctgccaagggcactccctcttttactacaaggccccacagatgagaaggctggcctcaggcatgtcaggcagccctagcatccctgctgagtgaccctgggtgagtccttgcctcggtttccccacatggacagtggagctgaccagccacctctgcctccaggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgc

SEQ ID NO: 5422 - DNA, 594 bp, Homo sapiens
  ENST00000596502
cccggctttgctgtccccacagagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaac

SEQ ID NO: 5423 - DNA, 1912 bp, Homo sapiens
  ENST00000629999
gtcggcgcgcgccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctcagtc

SEQ ID NO: 5424 - DNA, 1882 bp, Homo sapiens
  ENST00000336034
gcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggca

SEQ ID NO: 5425 - DNA, 1894 bp, Homo sapiens
  ENST00000595337
tcccgggctaagcgtcggcaagttctgtagagaaactcgggcaacctttggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaa

SEQ ID NO: 5426 - DNA, 1586 bp, Homo sapiens
  ENST00000593804
gggaaggaggaggggcgaggtgacgcaggcgtaataatagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctgg

SEQ ID NO: 5427 - DNA, 1183 bp, Homo sapiens
  ENST00000596251
aggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctag

SEQ ID NO: 5428 - DNA, 723 bp, Homo sapiens
  ENST00000601135
atagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgatggggaaacaggctcagagagacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggg

SEQ ID NO: 5429 - DNA, 715 bp, Homo sapiens
  ENST00000598415
ggtgacgcaggcgtaataatagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtggctgtacaagaagcagggtgccagcatctgcttctgttgaggacctccggaagcttccattcatggtggaaggccaaggggagcaggcttgtcacatgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctg

SEQ ID NO: 5430 - DNA, 763 bp, Homo sapiens
  ENST00000602075
gaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctggagtgcaatggcacaatctcggctcaccgcaacctccgcctcccgggttcaagcgattctcctgcctcagcctcctgagtagctgggattacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtggctgtacaagaagcagggtgccagcatctgcttctgttgaggacctccggaagcttccattcatggtggaaggccaaggggagcaggcttgtcacatgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctg

SEQ ID NO: 5431 - DNA, 550 bp, Homo sapiens
  ENST00000600559
taatagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctg

SEQ ID NO: 5432 - DNA, 463 bp, Homo sapiens
  ENST00000598090
gtaataatagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgatggggaaacaggctcagagaggtaaggtcacatgcccaaggccccacagcttagagagtggcagagctgggactcacctcaagacatccggctccgggttcgagcagagtactgcgagca

SEQ ID NO: 5433 - DNA, 1037 bp, Homo sapiens
  ENST00000598727
aaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgatggggaaacaggctcagagaggtaaggtcacatgcccaaggccccacagcttagagagtggcagagctgggactcacctcaaggtctgttggactccgccacctggccctgcctctgtggccaaccactcctgggtggcctggaagaggtgctgctcctcccagccccctgctctcccacccacattgattgaggtcatggccagttgcttactggagtcaaggatgcagtcaaggatctggtcgtctgggtagagacagctgggtctgaatgccatgggagggcctgggggctgaggctgggcaggcttccctgggcgttgggtggagaggatggggttcccctagagccagaaaga

SEQ ID NO: 5434 - DNA, 546 bp, Homo sapiens
  ENST00000593561
gcatttctctgggtcgctcccgggctaagcgtcggcaagttctgtagagaaactcgggcaacctttgtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgatggggaaacaggctcagagaggtaaggtcacatgcccaaggccccacagcttagagagtggcagagctgggactcacctcaaggtctgttggactccgccacctggccctgcctctgtggccaaccactcctgggtggcctggaagaggtgctgctcctcccagccccctgctctcccacccacattgattgaggtcatggccagttgcttactgga

SEQ ID NO: 5435 - DNA, 556 bp, Homo sapiens
  ENST00000602201
acctgcgcgagttgggggaaggaggaggggcgaggtgacgcaggcgtaataatagagaaggtgccagaaagatccaaaacaagtggctgcggccgtcgcccaggagtcatcggacgccagaatctgtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgatggggaaacaggctcagagaggtaaggtcacatgcccaaggccccacagcttagagagtggcagagctgggactcacctcaaggtctgttggactccgccacctggccctgcctctgtggccaaccactcctgggtggcctggaagaggtgctgctcctcccagcccc

SEQ ID NO: 5436 - DNA, 465 bp, Homo sapiens
  ENST00000598200
aaacaagtggctgcggccgtcgcccaggagtcatcggacgccagaatctggtgaggatccagagaggcctaatggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatgg

SEQ ID NO: 5437 - DNA, 2499 bp, Homo sapiens
  ENST00000265036
aaactgctgctcctccggctggcggggatcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgcca

SEQ ID NO: 5438 - DNA, 1569 bp, Homo sapiens
  ENST00000453022
atcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagat

SEQ ID NO: 5439 - DNA, 1596 bp, Homo sapiens
  ENST00000512078
atcagcgctggcgcggctgcggccgctgctgcctacgcgccatggagcatcgcatcgtggggcccgggccgtaccgagctaccaggctgggattgattctgttatcctgaagtggtccagtgtttcttatacttgaagattaggatcattgtgtgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaa

SEQ ID NO: 5440 - DNA, 651 bp, Homo sapiens
  ENST00000509006
atctaattttaaacaatttccaatggtgcctgtttccttttctttgaaaatctctggagaaatagttcctcttgctgtgtctttctttaggcaagaatttttactaattgatgtgtagtctgaatcctggctaagtataaaccttttattttttatacctgttcttagtgaaaatgaaactgtgactttttttttaattccttttgttggtcaaaaactacaattaactcttctgagtttcttctctggctgaacaaacaatggtcccattggcctttcagggaactccaggccgtctcaaaaaccttcatgtttcatttcttttcagagctcccaaaaagaatagcttgctcttgacgttgtacatgttagtggaatgatcaggactactttgcaaagatgaaaaatttgtgtttctagtgatttgaaaatagaaatctgatgtaactattagatattgggaaagaaggtgacgaaggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactggtaggt

SEQ ID NO: 5441 - DNA, 854 bp, Homo sapiens
  ENST00000505017
aagcacttttccatatttgcttcaaatggcctttagccccaaaaaattatgtcaaagaggaatgttttgaggtgacacattctgtttccttcagtactctcgttggtgagtctccagattcaccttcatataaacttcccttgaacactatagacattttataattctttatttctgcatttgctttgagataaggtctttagttatttgtatgatttttttctgtggataacatgggtaagatttttaagctgtttttttggcttaagtaaataaaaagtcaaaataaaagtcaacaacccgctgccttttatgtcaacattaagaactagagttcttacattgcttttgcagtgcaatgtaatgcattgtatccttttctaacaagactgcagaaaaatattatctgataaaaaatatgtattcaatcacctttcttttctttatcaggtatggtatagagcagtttaaaaaattaaaatttatgtaattattgtataaatattgtacaaattattgtataaattttcagatacaccaaagtggagactattgttaaaatatctgtgtctcccactgactgcagtaatagagaatttcttcttgggttttagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagat

SEQ ID NO: 5442 - DNA, 661 bp, Homo sapiens
  ENST00000512452
agcgcccgcagcccgcgggcttgggattcaaactgctgctcctccggctggcggggatcagcgctggcgcggctgcggccgctgctgcctacgcgccatggagcatcgcatcgtggggcccgggccgtaccgagctaccaggctgtttctatttttgaggccgggtgcagtggctcactcctgtaattccagcactttgggaggctgaggcggctggatcacttgagatcaagagttcgagaccaccctgaccaacatgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatg

SEQ ID NO: 5443 - DNA, 1755 bp, Homo sapiens
  ENST00000241051
gagccacgccccgcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataa

SEQ ID NO: 5444 - DNA, 1212 bp, Homo sapiens
  ENST00000427755
gcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggttggtatataatgttagattatcacgggaatattggcaggattttgtctacctttttatgagatgcctactggctttatattacatttttagcagtaaatgtggctaaaatatgggtctgtgggtaaatttgataaagtgcgatgaaattttgttagctttattgggtgtctcctagtcatattttatatttagcagaagcagtcaacacactttgattttcctgcttcaggttatagttgcagtgtaaaaagtgttctcataccacttggtatgagaacatagcgaaggcaggcagagagaaacccagattgcggtgggagagaagaaggaattatttaaagggaaactggggagacagaattgtggaatccagtgattgaaatggatgtgggtgataatgcataatgaacttacagctatttgtcatgaagtaaaccaactttaccctttcccctttgttaccctcagctaaactgtgcagtggtgacacagaggtataattgaagctcttatatcagatctgacctaaagtcagagttttagtgtattcattttcgtgtgtgtgtacttttttgaggcagggtcttaccctctcacccagactggagtgcagtggtgtgatctcagctcactgcattgtctgccttttgggctcaagcgatcat

SEQ ID NO: 5445 - DNA, 1118 bp, Homo sapiens
  ENST00000532078
agctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaaggtaagctaaggatgaagcaaagtaagaagtagaagacaaacttcaaagttatttaaaattttttaatcttaatctttattagattttaaatattcaaagtacagagaaagagtgcactatgtattaaagctgtttatgttcaattttaacagaagtctattatctttaacaaatagatcagtgttagaactcttgaacactgacttttgtccgatcagctggcaaaggttcagatctgagatgttttgcatgcagatttgtattgaaaatatgctctccgatgtttcttttcctaagattttattaggtcaagtaaaatttgaaaattacattaaaacattaacagaattcttcggttcttccttgtctgtagcaatggaatatagtttaatgactttaatttccaccctttcccccattccagttgtggaaaccctgagtggaataatctgcaaccaatagtttcaaacaagtttttagc

SEQ ID NO: 5446 - DNA, 2012 bp, Homo sapiens
  ENST00000311388
agctgcgaccacttggccaacgcccccgccgagcgggcggatcgagttcctctctggctggtgggctgcaagcggcagagcccgcccgcacagcccagcttttttctttctacccagactctcaacttgaccgcgcgttggtctgtgcgcccgctaacgtgccaggcacgcgccggggagctccgggatatgctccgcggtgctaccggtgacaagtgtggtatctggaatttgtgtagttctttgccccctgtctcaaccacaaaccttgacgacacagtatggccaggggccgagctcctcccttgcccactttgttctccagactgctaggagtcaagagtcagcttgtctccccagactcttcctgggagggatgagaggtttatgtgagttctactggcaggaatttggcataaaaggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataa

SEQ ID NO: 5447 - DNA, 2248 bp, Homo sapiens
  ENST00000373960
gtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccactcggctccccgctgagttcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaagccaa

SEQ ID NO: 5448 - DNA, 760 bp, Homo sapiens
  ENST00000477226
tgccagctttatcacccgcaactgtctgtctttctgtctgtcccacccaggctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgag

SEQ ID NO: 5449 - DNA, 706 bp, Homo sapiens
  ENST00000492726
agaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgaggtgagtgtctgctggcaggcgga

SEQ ID NO: 5450 - DNA, 462 bp, Homo sapiens
  ENST00000483395
tcttgaagaagtaacaagcctgtcttgaggggggttggggtctgctagggctctgcccaatgtggccccagatggactcccagcccctggtatagcccagcctggacttggtcaggctgagtgtgcgatggaccctgttacagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgc

SEQ ID NO: 5451 - DNA, 2590 bp, Homo sapiens
  ENST00000342947
agaaagcaatgtttgagcaccagctatgctgagattccctcgttcagtattcgttgagcacccagtgtgtgagagcgcctggttttgccctcaaggagcttagagtggagtttacaggaatgaatcactgattagcggcaggcctaagtgtgggcactgtcgcaccacacacccagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatgtc

SEQ ID NO: 5452 - DNA, 4182 bp, Homo sapiens
  ENST00000479636
gtgggaggctgatgggaaaccccccttcggtctcgagtctgtgcctttccatccagcacaagcctccctactctcccggagggcccttctccctcctcccccagggaaggccacagtgggtgcccctttgcctacaaaagcaagcatctccctgacaggctgtggttcactccggagtcccagcagagctgagtggcagcaactttcatttgccaactgctctcctccagcatttcagtccttctgatctttgcaaacttgttattccccaccctgcgtgctcctgtctggggcaagggggctgtggagagcattcaaccatccaatgtactaggctgggaggcagagctgtggctgggcccagatgcacagcttctgcactggtcctgaaatggcctcccaggggagcagccatccagttactgtggaacaatctctgccacctctgtacccctcccatccggaactcgccatgccacagtgcctgtcacgaggaagctgggcttcctattccctctcagaaaagccagttgtggcaaaccagtccccacagcttcccttcatggtgacactagtcaggacacatagtttctgatacattcagggttcctccctagcaccacacagaaacagacccagtaatcttcagtttttaaagaattaatctgagagaatgcctgtcccaactctatgtgctgataaatatatgctctgtcttgttccaactcatggataaatatagttttgactggtaaactgaaacaggacataagacagagccctgcggaactccactagagactttctcccaatgttaacatccgggtattagagtctttcagaacaggcattctgtcaggagctaatacacaggccagagttctccgacttgtgagaggtcttttcttcatataccccattacttattgcagcatttctatcaatagcctggatcagtgatgccaagtaggtaacacagggccagcatcatgaaagcaccacagtccccttctacttgagcctagacacagcatcaaattctctgcaactggctgggtgtggtggcccccatctgtaatcctagcgttttgggagggtaaggtggaaggatcacttgagcccaggagttcaagaccagcctagggaacatggcaagacctcatctgtacaaaaaataaattagccaggcatggtggtgtgtacctctgtagtcccagctacttgaggggctgtggaggattgcttgagcccaggaattcaaggatgcagtgaactatggacgccattgcagtccagcttggaaaaaaaaaaaaatctctgcaagcttgcacgcaggcagcaggccacgcagttgacacataatgtgagactgacttgctgtttctgaattggaaactcagaggtagtgaaatctttaggtgcagctggcaatgtctaaatttttcaaccaatcctgccctttatttttctgaactgtgatctcatttatatgtcagtcccagtggaggccaggctggcatacagcccttccatttgtgctcttgctaatcctccgcccttctgagttcattttttttcctcttaatataatcttctctccttaaaaactgaggaaagtgctggaatagaaaatggggtcttcgtaggtcctcacaccagtttctggctaatagctgttttcagcacttcagtcccacatgtgacctgtctcctgggaagcttcctccactattttgtaaccttaagcaactccaaaggtctcaactccttggactctatttgtaaaatagaattggtacatggaagagcaatcaaaataatttcagttcaagaaacatttaacaagcttatactatgttttaggcagtgctaggtaaatatcaagtcttggccctccaggaaatcagagtcaagtagtaaaattagtgggtaagctcggtaatgcagatgctgttctttcatttctgtgcccctagcacctagtgtaccacactcaagatagcagctaaatgggtaatatgggactcaggtatttccaagaataagagatgaggatgatggttacctgggtcccaggagccaccctggaaagtgaaggcagggcagtaatggcagatgagatggctggggacagaggctcagctggatacgctaggccacataggctttccgtcttcaccttcctgctttggggtaagagactacttgagaaactgtggatcttctcttcagacaaatgcatacacatttgaataccacattaggttctctgaaagaagcatccccctggctgctgccccacccccttaatagcctacactctctcttgagaacgagccatgtactctctgggtcacacctcaacaacacactgtctttacaaataaggctgctaacacatggcaggaacaactgagttcctaaccagtccctcggctacctgattcagcacgtgactcattcttttttgccttttcagctcaaagcttgtacccccaagggactatggtccttttaagaactgtatctgtgttttccctgggaggtgtttaatatccactttgaataacactgatctggcattcccttccctggggcttggcaagggcccttctggtgcagcccctagcctggcacagctctgctccaactttctgctgttgctgctcctggcctcaggccacgctgcactgataaagctacactgcattttcctccccaaaatgattggtgatggggtagagccctttatagtttacacagtattctgacatatgcaaaaacaaaacaactatggtaaatgaggaaactgaggctgagagaggtgtacctgaggctgcagcctgaatgtgtggagggtctcaaacatcactcttctgtcaccagatggcagggtctgcttttccatgctgtttcctttccttcccccagagtctgggcagttctttccatttggtaaattgaatgtcaaggagtatcctctgtggaatgcagagctggcagctgggttcctacatctgttttctacaaggtctttgctgcccatttagcaccattcattcactaactcagcaactgctgagtacctcccctgcctggctggcgggaaagtactaaaatataagttaggtgccatccaggggctggctctgttcccatggacttgtttttttggactgtgactgtgatttttctctcctgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactat

SEQ ID NO: 5453 - DNA, 2005 bp, Homo sapiens
  ENST00000409970
cccgccggcccagcgcaggctcctccgactccgccagcgcagggggcgcggctgccggggacccagcagcgggcgcgcggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtat

SEQ ID NO: 5454 - DNA, 1689 bp, Homo sapiens
  ENST00000409775
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttact

SEQ ID NO: 5455 - DNA, 450 bp, Homo sapiens
  ENST00000430096
cagctgtttatgacagcctacttcttggtcagtgccctcgcagaaatgccagatagcgcagcagctctgctgggcacttgctgcaaactccagatcattcccacactgtgccacttggtaagcaacctcccaggtgggaccttagaatggataggaatggggaaatgatgagggggtagacatccagcagccggtaaaacacctctaggacttaccacaacagctcttcaagacacattaagtaagtattgttattaaccccacttttatacacatcccaccccatgggaagactgagacccagaggaaaatgatttgtccaaataacttgttagcaggtccaggacttcatccttgtctttcgactccaactcttatacttttcccattgtttggagagaattttggccaaggtttggtgttacattacaataaaggggcctgacacca

SEQ ID NO: 5456 - DNA, 500 bp, Homo sapiens
  ENST00000415480
cagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgaaggatatcctggggaggtcaagttccttaactcttagttgtacaaatggtgagagccacacaagctgccaaccctccagccacccagattctgtgtcctccctttcttaaggctgaggctttataaacctgattttgactaca

SEQ ID NO: 5457 - DNA, 610 bp, Homo sapiens
  ENST00000446822
tcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgcagaaggatatcctggggaggtcaagttccttaactcttagttgtacaaatggtgagagccacacaagctgccaaccctccagccacccagattctgtgtcctccctttcttaaggctgaggctttataaacctgattttgactac

SEQ ID NO: 5458 - DNA, 583 bp, Homo sapiens
  ENST00000469133
tttgttggaagtggctgggcttttggtcaagcaacataatgtgtgtagggatcgaattttatggggaagatggatgggtcttctgctccactgagttacgtctaagatgtgccatcaaggctgggctgaccctgtccagacttgttggcacaccttagactcaactttacctaacttgtccttttctcctgcactacagagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtggtgagccctgagacatctcaaggcagtgttttcactggggttttctggaacaggggaggaggcaggatggaattgtgttaaaggttccccc

SEQ ID NO: 5459 - DNA, 734 bp, Homo sapiens
  ENST00000411476
gtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgcccccctatgtctgccttggtggtcctgtccagtcttactgatggccagtggtgaatgtgtcactcccccgcagcttactgagagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagagg

SEQ ID NO: 5460 - DNA, 557 bp, Homo sapiens
  ENST00000559637
ttcaacatgaaacttagaagggacaaacattaaaccacattggagcagggaaccgattccgggatgactccaggtctttgtgttatatcgacctgccagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaag

SEQ ID NO: 5461 - DNA, 1501 bp, Homo sapiens
  ENST00000493723
ataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcggtgagtgccacctcctatgggtgctgagggatccccagcagaggatccctcagcagagggacttgactgctttccagaggactcgactgctttggagactgtgggaagagagggaaagaggtctgaagagcgtagattgtcccaagacatggtccctggacacatgggctgcactgggggaggggtgtggtgagggatgcctggagcaatgccaccctctcctccaacattggtgtggggcaaagttccaccagcacagtagagggctgggctgtgtcctctgggcatcaacctgggctctgcatcagacacactgggcatcaaccccggtgccatgatgtcctatgaggtctcaggcaagttgctgaatcttgctgagtcttggcttccctgtctctggaaggtgaagggcatttcttcacagggctgtgtgaagatttaatgagatgaggcctatgaagcgcctggcacagtggtcatttattaattcctccacctttgctattaatagcattatcatcattattgttaccccacctcctctccacaagtatgaagccagacatgctgaacttgactttcctctgctgatcacgagtgtgttcaaagcgcagagacccagctgttgtcacggaagaaaatccaagctttggttcagcgtgtctgctcactttaggtgttcacagccccttccctcctcatgttcccaatgagaagaggttgtgttcactcatgaaagctgtgtgaccgctccttagggacatgagtgggtaaatgtaacataa

SEQ ID NO: 5462 - DNA, 571 bp, Homo sapiens
  ENST00000414428
cagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcat

SEQ ID NO: 5463 - DNA, 1641 bp, Homo sapiens
  ENST00000473990
gataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagaggtaaggagacttgtttggcattttggattttgacacatctcacatttaaaggtcattcagttggacctttgttaaaagggcgacagatttgatctctgccgatcaataaacatgtattgaatgcgcttgtgttgaaatttcatgaggagcacattctttagtctggaattgcttgactgttcttagcctgagtggggggagacttgggaagcactttcaaaggatgttacttcaggcaaatatgtacttccttcaatcacatgatttataaaatgcgaacggtaaaaatgctctgtcctgcatttttgaatattaactttagaagccaggaagtcatgacccccctctggctctataattttctgatgaaaaaaagaagaaagcaagtgagaggcgcgtaaaaaagttcaaaaataagagctcttttcagtctttgaagtcttgaagaaaaccccacatttattcattgtttggctttcggtaaatacatcttaccacactatagctcatcattattcttacctcatatttattcaacattcaaaaaataattgtattgagtgcgtcctatgtgccatgtactgttctacattctggggaggctgcagagagcaaaatgcccaaatgtctgccttgcattctagtgaggagagataccaaacgtacaactaaagtaaaatgtgcagtaggttgatgggaatcggcagcagtgagaggggctaggatgtgctaggaatgggggctacgaacttagaaagtgtggccagagaaggtgttatggagaagctggcattagggcaaagctctgcaggagggcagggaaggcacaggggcatctgggcaggacgctgtgggcagtggccagagtggcctgtgcccagtgagcaaggggagggcaggaaaggagagtcggaggggctgaaaggggtggggcgccaagtcccacaggaccttgaaggccactggaaaggctcacacttactgagagccagtggagggttttgggcagggaaggggcgtaatctgatgtattttttagaaggatcattctggctgctgagttaagagactggatgggcagcagcagggagttcagttgagaagttattgcagtaattcagcggggatgatatttcagtttgtacagtaacatgtgcattttcctgtgtaattttgttgccctttagtcttttaaagcaaaaattcaaatccaaata

SEQ ID NO: 5464 - DNA, 2265 bp, Homo sapiens
  ENST00000419307
aggagcttagagtggagtttacaggaatgaatcactgattagcggcaggcctaagtgtgggcactgtcgcaccacacacccagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 5465 - DNA, 1299 bp, Homo sapiens
  ENST00000440005
cggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcataccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaa

SEQ ID NO: 5466 - DNA, 5492 bp, Homo sapiens
  ENST00000438934
cgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagtgcttaggtagaggttgagcatcctaatcctgaaatctgaaatgctccagaatctgaaccttcttgagcaccaacctgacacttaaaggaagtgctcattggaggatctgtgacaattactaaaaacttccccaaataaaaaggacatgaaaagaatctcacgctatcgcccaggctggagtacagtggcgcgatctccgctcactgcaagctccgcctcccgggttcacgccattctcctgcctcagcctcccgagagtagctgggactacaggcgcccgccaccacgcccagctaattttttgtatttttagtagagacggggtttcaccgtgttagccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaaccctgatcacatttcaacatgagatttggaggggccagacctcaaaactgcatcagatacattcatgtttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggtaaggcctgggtatggggcacatggagagggcccattccagaggctcctaagtcaaaagagattccacaagtcaaaatcctgatcctgatcaagcacaggccttcacagtgacatttcactgtgaccctggcccagagacagagaccactgtcctgcagtgtccctgggagggaggttctgggtctgccacaggacaccacaccctggaacattgcacaccctttgcctggccttttcccagtgtttctgtcagaaatgccccctcccaagcatacaccccatcttgtgccccgagggactcgattctctccccacacacccgacccgaggctgtcatgggtagtgcctgctgctggccccagggttagggctgctcagccagtcctggctggaaaggatgaatgtcccacaagcagctttggggcctgcttggtgggagcagcccgaggatccgcccttcgtcctcctgccatttcccacttccctggctctggggtcctcatgttcacgtggttctcagtgactgggtgattgacccccatgagctgtcattattttggtgtcttttgctggacatttaagccattccttgtgtttctgccattagctattatgggctgtaacatctttgcacctgtgccttctttctttttaaatttctgaagtcctaatttgacccaaaggtgacacatctccctgtgtgccctgtcagtgatgaaacctgctctggggatgaagatgccgtggggcccacagatccaagctctcggagtgtgattctgtctcccctagaaacacatccatggcatgtcctcagggcatttgtgcatgggattaagcaaatgtttcctaatcatgtttgtccctgtgctctggcttcttgacctcaggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccagg

SEQ ID NO: 5467 - DNA, 568 bp, Homo sapiens
  ENST00000421572
gcgcccgccccgaagcgactttcggtccccgacccgctccgcctgacccctatgatgaagagggcgtccactggagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgattcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcag

SEQ ID NO: 5468 - DNA, 862 bp, Homo sapiens
  ENST00000399539
aacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgattcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcattgtcagtgggacgggagggtggtctgcccggggcttcaagctcctgtccaggaaccggacccatgtcgtacgccagtgcagccacacggccagcttcgaggtgctcatggacgtctccaggtgtgaga

SEQ ID NO: 5469 - DNA, 556 bp, Homo sapiens
  ENST00000546878
attactgagcgcttgctgcctgtaaaacagtcctcagggagccaagagaagttccgaggcacagtccctctcatccccaggaactcctcgtacgtccaggacctgcgagggaaaagggcgcaaggcccacctgcacccaaaaagggggccttataaatgaagaaaggaagaatatccaggctctggcctgcacccagatctcagagcggcttggtgacgtggagcagacaaactccaggaacgcactggggcgcacaagtgtttctagggacggttggagaccctatctaaccctaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaa

SEQ ID NO: 5470 - DNA, 592 bp, Homo sapiens
  ENST00000546995
ttttaccttcctgcttatatccccactttggcttagtttaatgtccagcagtacccctggaaccagggaggaggcaggaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagtgagttggggaccctgtatgctgggcaaggg

SEQ ID NO: 5471 - DNA, 542 bp, Homo sapiens
  ENST00000547015
atgatctcggctcactgcaacctctgcctcccaggttcaagcgattctcctgcctcagcctcgcgagtaactgggactacaggcatgtgccaccacgcccggctaattttttgtatttttagtagagacaggttttcaccgtgttagccaggatggtctcaatctcctgatctcgtgatccgcctgcctcagcctgccaaagtgctgggattacagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaat

SEQ ID NO: 5472 - DNA, 2909 bp, Homo sapiens
  ENST00000331886
acacaatacccacacatgcatatacccttctagtcagaggtctcccctcccccttcttcccacccccaggtgtaagaaggacgattccaggaacctaaggctttgttactctgccccattttcaatgaagggtaggagggagttagacaggggttggggcggggccagtgagcaggatgcctgggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttggga

SEQ ID NO: 5473 - DNA, 569 bp, Homo sapiens
  ENST00000555090
attttcaatgaagggtaggagggagttagacaggggttggggcggggccagtgagcaggatgcctgggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 5474 - DNA, 548 bp, Homo sapiens
  ENST00000549629
agttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatcttcctcagtggctttgagcagtgtgctgctcagatgtgcccatgactggaaatgggaggagtgggagatggggagatgtcagaaaaagatccggatctaccacagtctaactgggctgcattgtgcaaggtctcggctctctacccaccttcgctatacctggactgcttgctccagctctcagagaagaggagtaaagagtgactccaccaaaaaggt

SEQ ID NO: 5475 - DNA, 1900 bp, Homo sapiens
  ENST00000555218
agttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaacc

SEQ ID NO: 5476 - DNA, 613 bp, Homo sapiens
  ENST00000548479
agtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatgtgagtcttcctgtcaggccttcagttctggagaccctgccccagagaatccctcctcctcctcattacaccccctgccccccagcttcctcagtggctttgagcagtgtgctgctcagatgtgcccatgactggaaatgggaggagtgggagatggggagatgtcagaaaaagatccggatctaccacagtctaactgggctgcattgtgcaaggtctcggctctctacccaccttcgctatacctggactgcttgctccagctctcagagaagaggagtaaagagtggtactg

SEQ ID NO: 5477 - DNA, 599 bp, Homo sapiens
  ENST00000547324
tctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatgtgagttgcccttctg

SEQ ID NO: 5478 - DNA, 1734 bp, Homo sapiens
  ENST00000553084
ttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatggtcttaagaaacagaagaggatggggggagaggttgagtcctctaggactaaatttgaaagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtg

SEQ ID NO: 5479 - DNA, 1320 bp, Homo sapiens
  ENST00000547358
cctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggtgagaccctcggcagcagcggggaggggacaggagtgcctccccgatttcccacacgcacagagtggcatttagaatagagagctcatacttttaggattcaagtcagacccctctatttagggattcatgcacaatacagcttttcttccctctactttcttcccctcccaggc

SEQ ID NO: 5480 - DNA, 563 bp, Homo sapiens
  ENST00000548549
gactggggaaaataggtctaaaaggaaagaggaacgtgaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatggtcttaagaaacagaagaggatggggggagaggttgagtcctctaggactaaatttgaaagaagtggacaaaattatcctacagatga

SEQ ID NO: 5481 - DNA, 567 bp, Homo sapiens
  ENST00000549368
gactggggaaaataggtctaaaaggaaagaggaacgtgaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaat

SEQ ID NO: 5482 - DNA, 825 bp, Homo sapiens
  ENST00000548407
aaaaggaaagaggaacgtgaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagtgagttggggaccctgtatgctgggcaagggaatatgtgttaatttgtctgcaccctcctgccccaactcttccagggtcttaagaaacagaagaggatggggggagaggttgagtcctctaggactaaatttgaaagtaagtcccaagctcttgacccctcaaagagaatgctggatacatgaattgggtctgccttacaaacatacaaacacatttatttacttggcagacatacctgagaatgagaggtgtgaatctggggtggaacccaggaacactgatttctggaaaagagtttggatggtggtagtaaaggg

SEQ ID NO: 5483 - DNA, 548 bp, Homo sapiens
  ENST00000555025
agaagcagagctgccgccggcgcgggaagaagatgaggagcgcagcaaatggagaaaatgtgtccaaagccccggacatattcgagggagggtggagcaggttatggtgaactggaaacctagaaacgggcctctccaacttcgaagttcccagagtcgggggcgccgggcgcgggcgcggcgggcaggctggggtggggggcgggcagctatgtcgtcaggaacggggcggccccgctgcggccgcgtctgcctggcccgtcccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 5484 - DNA, 541 bp, Homo sapiens
  ENST00000551615
cccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatgtgagttgcccttctgaagtgaggtggcagggcagtga

SEQ ID NO: 5485 - DNA, 565 bp, Homo sapiens
  ENST00000547535
cccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaaggtatggtcaagcagatgtggtgtgtctcaatgatgtttcctgctacttttcccttctggagggtggtcggccagaagacaagttagaattcaccttcaagctgtacgacacggacagaaatgggatcctggacagct

SEQ ID NO: 5486 - DNA, 594 bp, Homo sapiens
  ENST00000549323
cccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatggtcttaagaaacagaagaggatggggggagaggttgagtcctctaggactaaatttgaaagtaagtcccaagctcttgacccctcaaaga

SEQ ID NO: 5487 - DNA, 1444 bp, Homo sapiens
  ENST00000549097
ccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtgagtaatgggagctgggaggtaggggaagagggtcagcccagctatctgtgggagcttgatgctgtaaacttagaaaagacctaggtttgaatcctgggctctgccactgactagttatgtgaccttgggaaagccacatcacttctttaagccttagtttcctcaactgaaaatgaggtaattgtgagcattaaaaaagttggtgcaagaaaagtgcttcagatggtgcatgcacatactataaaatgcaataaaaaatatctattatgattactgttgctgttagacctgggcctcccaagcattatccagctcagttcctgcctggcacatggatggtgtggggcaggcatgcagtagcagctgatcttttaggaggaagagtaaggaaaaggcgtgggttttggaggtgggcacttcaccccgaacttttattctgctacaccctcaagcaagggatcacatatctgatcctgcctcaccctcaggtaagaaggaaatagggggagaggctcagctaagcctcccaacttcttccttctccctcagtctgtaagtacactgttcacgaccagtgtg

SEQ ID NO: 5488 - DNA, 2671 bp, Homo sapiens
  ENST00000551156
agcccagctcgggctccagctccagcgccggcgcttcagctgcgaccgcgagccctctcaagcaaggtagagaccccgcgagccccccagcgccccaccctcccccatcggaaaaggacaggggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaagtaa

SEQ ID NO: 5489 - DNA, 2582 bp, Homo sapiens
  ENST00000402956
agcccagctcgggctccagctccagcgccggcgcttcagctgcgaccgcgagccctctcaagcaaggtagagaccccgcgagccccccagcgccccaccctcccccatcggaaaaggacaggggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaagtaa

SEQ ID NO: 5490 - DNA, 564 bp, Homo sapiens
  ENST00000553783
agctcgggctccagctccagcgccggcgcttcagctgcgaccgcgagccctctcaagcaagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagg

SEQ ID NO: 5491 - DNA, 505 bp, Homo sapiens
  ENST00000557080
gctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcggatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 5492 - DNA, 591 bp, Homo sapiens
  ENST00000432422
agctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaat

SEQ ID NO: 5493 - DNA, 497 bp, Homo sapiens
  ENST00000556001
agccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcag

SEQ ID NO: 5494 - DNA, 574 bp, Homo sapiens
  ENST00000550115
gcgagccccccagcgccccaccctcccccatcggaaaaggacaggggtagggaagccgaggacccacgggctgcgttcgtgctgctgggtcgggaaggaggaagcgtgacagctggagcgggagaaatgagccttcctgaggaagaatggcaaatattactgggcatctcttcagcctcagcacagacaagcccacatcccccaaccatgccagtatcgtaacttcctcctatactacgcaatgacaccctctacacacacacacacacgcacacacacacacacacacacacacacacacaaccccctcagccaggtgtagcactgcagtcttcagtgtttgtggaggcttaataagttttgaggcttcaagcaaatgattccctcttgagggctacctactagcagcaacggtcagggagaggaggaggatacagtctatgatgtgattaaggaattcagaagtccaggtcttcaagtccccaggatcccacagtttgctgcccttcagctccagggatagctaaactttcagtcagagaagtcaagaaaaccactgaaaagatcccaggag

SEQ ID NO: 5495 - DNA, 540 bp, Homo sapiens
  ENST00000548378
catcggaaaaggacaggggtagggaagccgaggacccacgggctgcgttcgtgctgctgggtcgggaaggaggaagcgtgacagctggagcgggagaaatgagccttcctgaggaagaatggcaaatattactgggcatctcttcagcctcagcacagacaagcccacatcccccaaccatgccagtatcgtaacttcctcctatactacgcaatgacaccctctacacacacacacacacgcacacacacacacacacacacacacacacacaaccccctcagccaggtgtagcactgcagtcttcagtgtttgtggaggcttaataagttttgaggcttcaagcaaatgattccctcttgagggctacctactagcagcaacggtcagggagaggaggaggatacagtctatgatgtgattaaggaattcagaagtccagatataacttccccaagtcacacagtggtatcagagctaagaatgggacccagatatgactgatctagttctgttccaaaaccgtgctgtattatatta

SEQ ID NO: 5496 - DNA, 4076 bp, Homo sapiens
  ENST00000551296
agagctaagaatgggacccagatatgactgatctagttctgttccaaaaccgtgctgtattatattaacgtaagatatgttattatcattactgaatcaaggaaagtcgcccactgcaccttggtccctggatccagtagccaaaacctggggctccctaagcactgctgacctagcggagtggaaggaagttcccaggagccgagacactagcactcggctccatcgtcccaggactgggaaacactagatctgttggcagcagaagttggattatagtcattgaaaagtgccagatgggtagagtcctttctctaggatgtcagtatcccagaaccctcttctgaggaagagactctgtgggtacccagagtctcttcccctgcctcttccctaccccgcgcctagttccccacccttccctagtggagctccgcggaacgcagtccaggcggggccggggctagggaccttgccagagctggttctgtgtcgcgcgtcagaagcgctagaggtcgttgcgtggcgtgggtggctcggggagtgggtggctgagcggagctggggtccctggccagaggcggaacaaaatggggtcatggccaggaagacgcgctaacgcagtaagagtcactcagagggccggaactgccggaactgccgaagacccgagatgggagagagctcaggatggggagagtctgcagagattgacgatggtggaagaaagcgcagaaacagacaagggacacacccacagaaacatatatagactgagaaagccgggtgcgggtgggaaggtgagggtggtcagatgaatcaagataggttgggggagagggagaaggatccagaaatggagagacagagatgagtcagagaaacagagacagaggacagacactgtcagggaaggtagaggcatagggaagagggacacagggaaaggaagatgtttagggagggactaggagagaaggaaagaacaaaaaataatagtgggagtagagacagaatggaacagacagaagaaaagacacccagacagctggctcttcccactgtacgctctgtcacctttccccaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatgtgagtcttcctgtcaggccttcagttctggagaccctgccccagagaatccctcctcctcctcattacaccccctgccccccagcttcctcagtggctttgagcagtgtgctgctcagatgtgcccatgactggaaatgggaggagtgggagatggggagatgtcagaaaaagatccggatctaccacagtctaactgggctgcattgtgcaaggtctcggctctctacccaccttcgctatacctggactgcttgctccagctctcagagaagaggagtaaagagtggtactgttttggaggatctgaaatatttttccctctgtatttctgtgtttcttcttggaatttcttcatctcatttgaatcttttttcctgctggatttctctggcaagagaactcagctggactaataatgctgttctcttactctctctacaccctagactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgct

SEQ ID NO: 5497 - DNA, 605 bp, Homo sapiens
  ENST00000551707
gtcagaagcgctagaggtcgttgcgtggcgtgggtggctcggggagtgggtggctgagcggagctggggtccctggccagaggcggaacaaaatggggtcatggccaggaagacgcgctaacgcagcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctca

SEQ ID NO: 5498 - DNA, 5436 bp, Homo sapiens
  ENST00000552478
cagatgaatcaagataggttgggggagagggagaaggatccagaaatggagagacagagatgagtcagagaaacagagacagaggacagacactgtcagggaaggtagaggcatagggaagagggacacagggaaaggaagatgtttagggagggactaggagagaaggaaagaacaaaaaataatagtgggagtagagacagaatggaacagacagaagaaaagacacccagacagctggctcttcccactgtacgctctgtcacctttccccaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatgtgagtcttcctgtcaggccttcagttctggagaccctgccccagagaatccctcctcctcctcattacaccccctgccccccagcttcctcagtggctttgagcagtgtgctgctcagatgtgcccatgactggaaatgggaggagtgggagatggggagatgtcagaaaaagatccggatctaccacagtctaactgggctgcattgtgcaaggtctcggctctctacccaccttcgctatacctggactgcttgctccagctctcagagaagaggagtaaagagtggtactgttttggaggatctgaaatatttttccctctgtatttctgtgtttcttcttggaatttcttcatctcatttgaatcttttttcctgctggatttctctggcaagagaactcagctggactaataatgctgttctcttactctctctacaccctagactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatgtgagttgcccttctgaagtgaggtggcagggcagtgaagggagagagaggtgtttcccatcctcctttcccttattccttcaggattcctaaaggctgacaggtctagacaaaggtggggccagagaatgagcccatttcctgtgttctcccagactatttatacctaatacccttcaccatagtcaccccagtacccatgtcttgtgcattcccatgtaggcggcctaggatgtccttgggatatggattatgtattgtctcccctgacacattcactgagggtagagtccatgcctgttttcctttcctttttgtctctctctcagtcccatcccaggctctaggcttctcacccaaaagctctctccctgtctctttgtttcccccatattctggtatgaattctttgggtatctctcacaaactgaccctggcccccctaaaacaccccacagtcaccttcaagctgtacgacacggacagaaatgggatcctggacagctcagtgagttggggaccctgtatgctgggcaagggaatatgtgttaatttgtctgcaccctcctgccccaactcttccagggtcttaagaaacagaagaggatggggggagaggttgagtcctctaggactaaatttgaaagtaagtcccaagctcttgacccctcaaagagaatgctggatacatgaattgggtctgccttacaaacatacaaacacatttatttacttggcagacatacctgagaatgagaggtgtgaatctggggtggaacccaggaacactgatttctggaaaagagtttggatggtggtagtaaaggggatatggctgtggctcttgccctttttgctccaggaagtggacaaaattatcctacagatgatgcgagtggctgaatacctggattgggatgtgtctgagctgaggccggtaaggcagctcttccttcatgtcccttcttgtaccttcttccctggtgagtcctgcatctgccttacttcatctctgacaggcaacctggttcccttggctaggatggctgggctggatatcctaagaggcagtggagaggtgttgggtctgaagacccactcatactgaaagtccctttccactctgtgctcagattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcgggtacagggctgagagtcttgggcttcatgatgggggcaggtttttcactggagccctcatgggtgggaatgaagtgggagagcctggtggggagcggttgatgctcactctccagaaactccaccatggtaggggagggaaggggagggaaacaggagggaggggggaaatatcttggtggaatgctagccctctgcccctgtctcctgggcccaccttaactctgacaaaatcctgctttctttgtccttattttcttcccccaatgcagattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggagatggaatctcgctctgttgcccatgctggagtgcagtggtgccatctcagctcactgcaacctctgcctcccaggttcaagtgattctcctgtctcagcctcctgaatagctggaaatacaggtgttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggtcagtggaatggggcctggggagaagggagaaagggggggccaagcagtcagaggctggaggagagcagaaaaggagggggaggttaagtgacctgtgacacagggaaattgggagtgcagtacagtgctgagttgcaagggaagatcttgggacatgctgtggggagcagcatggggacttgggaaagaggggagaccgggagggagagattgagctctgtactgaccttcatgtcccgaactctccaggatgcctctattgctcatcgattccacatcatgcgagagaaatatccggagaagttcaacagcaggttagggaaaggagggggcagtgtgggcatacacagtgtcaggagccaggttttgaccaagtttgactcagattgctcagaagaacagtggcacctctaggaggtccccccaaccaaagccacccttgttccccatgggactaaagttaggaggttgatgcccttccctgtcacgtaccacccctgccagcactgtgtaacctgtccctccctactgggccttgtgttggggctgacacagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacagtgagtattgacgatcccagccaaaaattaaacccttgggctccatggatcctaaatccccattccacagcttctttacacccttctgatgcctgaacttcccctgcacatcattcatcctaaaccctgatttctcagcccctggtttccctatcgtggcctctctaggaacctagcaacccaccccaaaccccacagatttccctctaaatctctgaagccacagccccaaagtatcaggtcctgcctctgaatgtgctcccttcccttccagatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgct

SEQ ID NO: 5499 - DNA, 585 bp, Homo sapiens
  ENST00000550888
aacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatgaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctg

SEQ ID NO: 5500 - DNA, 540 bp, Homo sapiens
  ENST00000556344
gagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtgagtaatgggagctgggaggtaggggaagagggtcagcccagctatctgtgggagcttgatgctgtaaacttagaaaagaccta

SEQ ID NO: 5501 - DNA, 1961 bp, Homo sapiens
  ENST00000549079
atgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccag

SEQ ID NO: 5502 - DNA, 4357 bp, Homo sapiens
  ENST00000551739
gtgcattcccatgtaggcggcctaggatgtccttgggatatggattatgtattgtctcccctgacacattcactgagggtagagtccatgcctgttttcctttcctttttgtctctctctcagtcccatcccaggctctaggcttctcacccaaaagctctctccctgtctctttgtttcccccatattctggtatgaattctttgggtatctctcacaaactgaccctggcccccctaaaacaccccacagtcaccttcaagctgtacgacacggacagaaatgggatcctggacagctcagtgagttggggaccctgtatgctgggcaagggaatatgtgttaatttgtctgcaccctcctgccccaactcttccagggtcttaagaaacagaagaggatggggggagaggttgagtcctctaggactaaatttgaaagtaagtcccaagctcttgacccctcaaagagaatgctggatacatgaattgggtctgccttacaaacatacaaacacatttatttacttggcagacatacctgagaatgagaggtgtgaatctggggtggaacccaggaacactgatttctggaaaagagtttggatggtggtagtaaaggggatatggctgtggctcttgccctttttgctccaggaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtgagtaatgggagctgggaggtaggggaagagggtcagcccagctatctgtgggagcttgatgctgtaaacttagaaaagacctaggtttgaatcctgggctctgccactgactagttatgtgaccttgggaaagccacatcacttctttaagccttagtttcctcaactgaaaatgaggtaattgtgagcattaaaaaagttggtgcaagaaaagtgcttcagatggtgcatgcacatactataaaatgcaataaaaaatatctattatgattactgttgctgttagacctgggcctcccaagcattatccagctcagttcctgcctggcacatggatggtgtggggcaggcatgcagtagcagctgatcttttaggaggaagagtaaggaaaaggcgtgggttttggaggtgggcacttcaccccgaacttttattctgctacaccctcaagcaagggatcacatatctgatcctgcctcaccctcaggtaagaaggaaatagggggagaggctcagctaagcctcccaacttcttccttctccctcagtctgtaagtacactgttcacgaccagtgtgccatgaaagccctgccttgtgaagtcagcacctatgccaagtctcggaaggacattggtgtgagtgatctcatgcctccacccccaacatcacctacatcctggccctggccctggcccttggcccattgctgccctcagcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggagatggaatctcgctctgttgcccatgctggagtgcagtggtgccatctcagctcactgcaacctctgcctcccaggttcaagtgattctcctgtctcagcctcctgaatagctggaaatacaggtgttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggtcagtggaatggggcctggggagaagggagaaagggggggccaagcagtcagaggctggaggagagcagaaaaggagggggaggttaagtgacctgtgacacagggaaattgggagtgcagtacagtgctgagttgcaagggaagatcttgggacatgctgtggggagcagcatggggacttgggaaagaggggagaccgggagggagagattgagctctgtactgaccttcatgtcccgaactctccaggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgaggtgtgtgtaataagacttaaccctacatccttttcagcttcttaatagccaagtttctccctccatggcacccttaggaacttcccatattcttgaacctatgcttctttaacctcccagctctcctaccccaattctccaagtcctcaagatacactagtccctatttccattccttgcacacctccaaatcctgccttctccagtttgtcatctggtggagggagcgatcacatctatgatcatgccatgaggtgaggatctgtaccctccctaactgggactgtgccccctcctctcagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacagtgagtattgacgatcccagccaaaaattaaacccttgggctccatggatcctaaatccccattccacagcttctttacacccttctgatgcctgaacttcccctgcacatcattcatcctaaaccctgatttctcagcccctggtttccctatcgtggcctctctaggaacctagcaacccaccccaaaccccacagatttccctctaaatctctgaagccacagccccaaagtatcaggtcctgcctctgaatgtgctcccttcccttccagatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttggg

SEQ ID NO: 5503 - DNA, 527 bp, Homo sapiens
  ENST00000549085
acagctcagaagtggacaaaattatcctacagatgatgcgagtggctgaatacctggattgggatgtgtctgagctgaggccggtaaggcagctcttccttcatgtcccttcttgtaccttcttccctggtgagtcctgcatctgccttacttcatctctgacaggcaacctggttcccttggctaggatggctgggctggatatcctaagaggcagtggagaggtgttgggtctgaagacccactcatactgaaagtccctttccactctgtgctcagattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtgagtaatggga

SEQ ID NO: 5504 - DNA, 699 bp, Homo sapiens
  ENST00000552687
gaagaggatggggggagaggttgagtcctctaggactaaatttgaaaatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtgagtaatgggagctgggaggtaggggaagagggtcagcccagctatctgtgggagcttgatgctgtaaacttagaaaagacctaggtttgaatcctgggctctgccactgactagttatgtgaccttgggaaagccacatcacttctttaagccttagtttcctcaactgaaaatgaggtaattgtgagcattaaaaaagttggtgcaagaaaagtgcttcagatggtgcatgcacatactataaaatgcaataaaaaatatctattatgattactgttgctgttagacctgggcctcccaagcattatccagctcagttcctgcctggcacatggatggtgtggggcaggcatgcagtagcag

SEQ ID NO: 5505 - DNA, 621 bp, Homo sapiens
  ENST00000546895
aatttgaaagtaagtcccaagctcttgacccctcaaagagaatgctggatacatgaattgggtctgccttacaaacatacaaacacatttatttacttggcagacatacctgagaatgagaggtgtgaatctggggtggaacccaggaacactgatttctggaaaagagtttggatggtggtagtaaaggggatatggctgtggctcttgccctttttgctccaggaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtgagtaatgggagctgggaggtaggggaagagggtcagcccagctatctgtgggagcttgatgctgtaaacttagaaaagaccta

SEQ ID NO: 5506 - DNA, 566 bp, Homo sapiens
  ENST00000549986
tgggtctgccttacaaacatacaaacacatttatttacttggcagacatacctgagaatgagaggtgtgaatctggggtggaacccaggaacactgatttctggaaaagagtttggatggtggtagtaaaggggatatggctgtggctcttgccctttttgctccaggaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggt

SEQ ID NO: 5507 - DNA, 780 bp, Homo sapiens
  ENST00000552335
gaatgagaggtgtgaatctggggtggaacccaggaacactgatttctggaaaagagtttggatggtggtagtaaaggggatatggctgtggctcttgccctttttgctccaggaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagaggtcagtttgggagccatcccttctgggtgcgtcttaccccgcagagctgccttctccacgggcctccggccacacctcctttacaggcacagttgcccctgctcccaagggctctttccagcccagactgccaggttgagaggagacag

SEQ ID NO: 5508 - DNA, 2031 bp, Homo sapiens
  ENST00000548047
gatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtgagtaatgggagctgggaggtaggggaagagggtcagcccagctatctgtgggagcttgatgctgtaaacttagaaaagacctaggtttgaatcctgggctctgccactgactagttatgtgaccttgggaaagccacatcacttctttaagccttagtttcctcaactgaaaatgaggtaattgtgagcattaaaaaagttggtgcaagaaaagtgcttcagatggtgcatgcacatactataaaatgcaataaaaaatatctattatgattactgttgctgttagacctgggcctcccaagcattatccagctcagttcctgcctggcacatggatggtgtggggcaggcatgcagtagcagctgatcttttaggaggaagagtaaggaaaaggcgtgggttttggaggtgggcacttcaccccgaacttttattctgctacaccctcaagcaagggatcacatatctgatcctgcctcaccctcaggtaagaaggaaatagggggagaggctcagctaagcctcccaacttcttccttctccctcagtctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattggtcagtgcagggaggggcgtggggaaggtattggggtcgtagtcttgcagagctaactcactccatccttctcttcacctgcctccgcagacaaagctaacttgccagttttgcctcctgttgctgtgttgcccctgggtactggaaatgatctggctcgatgcctaagatggggaggaggtaagtggttagaaattgttttgctgtaggctgagaggagttgtgtaggaagggaaaggcacttagagaagaaactaggcatctggtatggaaaggattggggaagaagaggggcacagacaggtggatacaaaagtggaatgtccaaaaagaagagagctttggaagaagcagggaccacaatctgaacctagaagggtcaagggtgatagtcccctttcctgtaaatatttttatgtttctcccaaccaactcttatggctcagagaatcaaggaatatgggggtggggaacaatgtgtgaataaggaaggttgtataagagctaagccagatgctgaatgatggagctagcaggtcatgactcattcactcattcaaacaat

SEQ ID NO: 5509 - DNA, 750 bp, Homo sapiens
  ENST00000554434
gctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtgagtgatctcatgcctccacccccaacatcacctacatcctggccctggccctggcccttggcccattgctgccctcagcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagg

SEQ ID NO: 5510 - DNA, 698 bp, Homo sapiens
  ENST00000557180
tgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttg

SEQ ID NO: 5511 - DNA, 782 bp, Homo sapiens
  ENST00000552652
gagtcaagcattggtcttggcaaacagggactgagctgtaacctctgtaagtacactgttcacgaccagtgtgccatgaaagccctgccttgtgaagtcagcacctatgccaagtctcggaaggacattggtgtgagtgatctcatgcctccacccccaacatcacctacatcctggccctggccctggcccttggcccattgctgccctcagcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagaggtcagtttgggagccatcccttctgggtgcgtcttaccccgcagagctgccttctccacgggcctccggccacacctcctttacaggcacagttgcccctgctcccaagggctctttccagcccagactgccaggttgagaggagacagggttaccttcgtgatctctctgtgcccacctcgtctttcagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcgggtacagggctgaga

SEQ ID NO: 5512 - DNA, 453 bp, Homo sapiens
  ENST00000550484
agtaaggaaaaggcgtgggttttggaggtgggcacttcaccccgaacttttattctgctacaccctcaagcaagggatcacatatctgatcctgcctcaccctcaggtaagaaggaaatagggggagaggctcagctaagcctcccaacttcttccttctccctcagtctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagaggtcagtttgggagccatcccttctgggtgcgtcttaccccgcagagctgccttctccacgggcctccggccacacct

SEQ ID NO: 5513 - DNA, 607 bp, Homo sapiens
  ENST00000552903
ctgcggattgaccctgttcctaacacccacccacttctcgtctttgtcaatcctaagagtggcgggaagcaggggcaaaggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgt

SEQ ID NO: 5514 - DNA, 678 bp, Homo sapiens
  ENST00000551585
gtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattggtcagtgcagggaggggcgtggggaaggtattggggtcgtagtcttgcagagctaactcactccatccttctcttcacctgcctccgcagacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctg

SEQ ID NO: 5515 - DNA, 224 bp, Homo sapiens
  ENST00000550957
accagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacagtgagtattgacgatcccagccaaaaattaaaccctt

SEQ ID NO: 5516 - DNA, 533 bp, Homo sapiens
  ENST00000548491
tggggcagcagaagggtcatgggaatggtggggaggggctttactagatctccctcaatgacaaaaggtctcaaagccaacctaagaagcagagttttggtattcgattggtaaggaaatcaccaatgttccttggcctcctatagcaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctt

SEQ ID NO: 5517 - DNA, 2770 bp, Homo sapiens
  ENST00000394147
gcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgct

SEQ ID NO: 5518 - DNA, 6917 bp, Homo sapiens
  ENST00000403951
attttcccctgagctccatcagcaagagtagcaatagcagctggagaagcggcagccagagataggcagggctggtgcttgcagccgcgcaaatcgcctcctcctcaacacacacacacacacacacacacacacacacacacacacactgcacagacttccaatatcaacgcgtcttgacataaatcaaggactaagagagactgaagaagagcgttagtcatggacaacagttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatctacatagaaccagaaagtttaaaagacgtaaatttattttttccacttccttgtgtacaccatgtatttcatgtgaaaatgctgatcaatttattgtggtggaaggagatatcttgcaggaagtttaaaaattaacattttaaaacagtttttattttatttaaaacaggttcatgtgatcatagccagaataaaacaaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaaaattagccaggcatggtggcacatgcctgtaatcccagctactcgggaggctgaggcagaagaattgcttgaactcgggaggctgcggttgcagtgagccaagatcacaccactgcactccagcctgggtgacagagccagactctgtctcaaaaaaaaaaaggaaaatgtacttttcatggcacgtataacccccaaaggattattcaatactgaacaattaaataataattgaataatattgaatcatgttctccgttatttttcaaataactgaataatatctctattaaaagattaaacccttgtaacatatattaaagctgtaaactttaagaaaataaataaataaaaccctgtaaaagagcttttattttgtgagaggcagaaatcaccacttaaaactcccaattaaattctgctatatttaaataaagtttgagtaaactcacatttgagagattctgtataaccttattgtgtttaaaaacatggaacttaattatagtaccttaattattttctcagaaatgatatatacaatatcctgttttttgaaataaaaacgttaaccactca

SEQ ID NO: 5519 - DNA, 5595 bp, Homo sapiens
  ENST00000402815
ggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatc

SEQ ID NO: 5520 - DNA, 3651 bp, Homo sapiens
  ENST00000407950
atctttcagacactagttccaatgggccgggtgttctggaagggggtggcagtggggaggaggatgctgtgagcagagttcttgaagctccactcctctggggaagccgagctgtgtgggagccttcttactgtgccgggagcgtgtgaattggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaa

SEQ ID NO: 5521 - DNA, 567 bp, Homo sapiens
  ENST00000493142
gcactctgggtaaagccagctgccatgtcataaggagatcaagcagctccacagaaaagtcagcatggcaaggagctaaggctttctgccgatagcctctgagggactgaggcctccagccaacagccacgcaaatgagccatcatggaatcagatcagcccaagttaaaccttcagcttcttggtgatggcttacctgaatcatcatgacagactcagtcagagtcacctggccctgaatccttgacccacagaaactgtgagctaataaatgtgtgttgttttgagctgctaaacaaaaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaa

SEQ ID NO: 5522 - DNA, 3257 bp, Homo sapiens
  ENST00000406247
ggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacagtgagtacagagtagttgatatgctatgtcaatctcagttttgctttcctctttgactaaataaccacaataactgatttttttctttatttcttttcaacctatcagcaaatagtctttttgttgttgttgttatgtgtgtgtcagagccactacatttaggttgtagacattatatacccttggcaatgatttagctcttgaatgtttgtgttagcctaagtataaatagatcttttaaatagatcaattataaaccatagatcaattataaactatggagctaaacaaaatattaataaaagtttatctgaaacttttttgtttatttcagagcacattattagaatattatttgcaagaaatgcagacctaagcttatatgtgaacttatttctcagcttttctatgcctccatttggggatttgagggctttcttctccataagaaaaaaatttctctccagtttctaccataattaattgtgttttccagaatgaggtattatttaaggcagacactgcccctctcaaaaaaaaatcagttttcatttgcatagtgaatattttattgcatttcaaaaacatgctaggaactgcttttggcactgggagtagacacatgaacaagaccaacagtgtaatttccttcaagttacttacattcctataatagaggaccgaataaataaacaactacatgataaatataacttcagactgtgagagttattaaaaaataaggtgaaatgatgataagaagctggattaggtgtggagaataaatactacttgagataagggagacctctttgaaaggacatagccaaaagcttagtataaaattaaaaaaaataaaaaaaaaa

SEQ ID NO: 5523 - DNA, 3174 bp, Homo sapiens
  ENST00000403963
gaagtgggaggagtgagaggtggggaagggggacgccaaagatgactttcaggctccggaaacctacgtctttcagcctccgctgttttttagttgcaaatgatcagagacgggtgaactgcaggcagcctgtgttgctgcctggaagtagatttccatctttcagacactagttccaatgggccgggtgttctggaagggggtggcagtggggaggaggatgctgtgagcagagttcttgaagctccactcctctggggaagccgagctgtgtgggagccttcttactgtgccgggagcgtgtgaattggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaaggagtggagctctgtgcagctgaagactgcatatgacctcctgaatataggataaaaaaacctttggaaggagacaagatcattactccagagaatagccttgtgtagttgctgtcctactgaagtggagaaagggcatccaaatgttttgatcttgtttttatagttgcaagcagtgtctgtatctttccaaatacccaatcttgtcgtatatatctctctatgaaaaggaatttcaatgctacttaattttggtttagggggagatgggactgactttaattattcatttgaagcaaataaatgtttaaacatgagatacaatttaaaaattgatgaatggtgatggttttttaaatttggcgttttttttttttctatcagtagtaatagttactcaggcttatactcatgtcctcaatatataaggactgcttgtttcccactcagcatctagctataattatattctgtttgag

SEQ ID NO: 5524 - DNA, 674 bp, Homo sapiens
  ENST00000471732
tattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtgaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgg

SEQ ID NO: 5525 - DNA, 1959 bp, Homo sapiens
  ENST00000477401
atctttcagacactagttccaatgggccgggtgttctggaagggggtggcagtggggaggaggatgctgtgagcagagttcttgaagctccactcctctggggaagccgagctgtgtgggagccttcttactgtgccgggagcgtgtgaattggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtatgattttttaaatcaaaattttagtaggtttcatatttgatacttctaggctctaaaggggcatatgttcagctatcaacacatttgtttaatctgcatattagcttagtagactctttcagaaagatctttattaatttatcaagatgtcagtcttacggttgattgacagagtaacattctggttaaattaatcatttatgattttatctccatttaaactcaaattggcaa

SEQ ID NO: 5526 - DNA, 582 bp, Homo sapiens
  ENST00000464065
aaagaactctccttcatctacaacagtcgtaggctatgtctagctgctgtaccgatcttacagagaatttggttattctatgcctaaaaaatataaatttctatgtagcctgtgtgttctctattttcttaatttgttttctgtttgagatcactgtaaataattaacaaaatataaagacaattttttttccaggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaa

SEQ ID NO: 5527 - DNA, 472 bp, Homo sapiens
  ENST00000467449
agttgcaaatgatcagagacgggtgaactgcaggcagcctgtgttgctgcctggaagtagatttccatctttcagacactagttccaatgggccgggtgttctggaagggggtggcagtggggaggaggatgctgtgagcagagttcttgaagctccactcctctggggaagccgagctgtgtgggagccttcttactgtgccgggagcgtgtgaattggaaaggatcctgagaactggctagtcccagttcctctccggaaaagcagtggctctcgcttcagagatgcgctcagctttcgcctgcatcacactgcaattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagctt

SEQ ID NO: 5528 - DNA, 494 bp, Homo sapiens
  ENST00000437998
acataaattagtaccttactggctagggaatgttgaatcacagttggatgaagaaacaattcatgttaatgtttctctaaagttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagctt

SEQ ID NO: 5529 - DNA, 558 bp, Homo sapiens
  ENST00000463981
gtctcattttcccctgagctccatcagcaagagtagcaatagcagctggagaagcggcagccagagataggcagggctggtgcttgcagccgcgcaaatcgcctcctcctcaacacacacacacacacacacacacacacacacacacacacactgcacagacttccaatatcaacgcgtcttgacataaatcaaggactaagagagactgaagaagagcgttagtcatggacaacagttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatgacaatagattttgaaggtttc

SEQ ID NO: 5530 - DNA, 6684 bp, Homo sapiens
  ENST00000399322
ttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatctacatagaaccagaaagtttaaaagacgtaaatttattttttccacttccttgtgtacaccatgtatttcatgtgaaaatgctgatcaatttattgtggtggaaggagatatcttgcaggaagtttaaaaattaacattttaaaacagtttttattttatttaaaacaggttcatgtgatcatagccagaataaaacaaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaaaattagccaggcatggtggcacatgcctgtaatcccagctactcgggaggctgaggcagaagaattgcttgaactcgggaggctgcggttgcagtgagccaagatcacaccactgcactccagcctgggtgacagagccagactctgtctcaaaaaaaaaaaggaaaatgtacttttcatggcacgtataacccccaaaggattattcaatactgaacaattaaataataattgaataatattgaatcatgttctccgttatttttcaaataactgaataatatctctattaaaagattaaacccttgtaacatatattaaagctgtaaactttaagaaaataaataaataaaaccctgtaaaagagcttttattttgtgagaggcagaaatcaccacttaaaactcccaattaaattctgctatatttaaataaagtttgagtaaactcacatttgagagattctgtataaccttattgtgtttaaaaacatggaacttaattatagtaccttaattattttctcagaaatgatatatacaatatcctgttttttgaaataaaaacgttaaccactca

SEQ ID NO: 5531 - DNA, 4246 bp, Homo sapiens
  ENST00000337343
tccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgca

SEQ ID NO: 5532 - DNA, 17261 bp, Homo sapiens
  ENST00000261491
tccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacgatgttcctgcctgaaatgtctttctttttcttgcatgtcacatctaatactgtaacactttaaatagctttcatgtcagttttaatgttaatgggatttaatttattactaaagtacatttttgttggttaagggcactgcacttttctgttttttaatgtgggattttgcgtaaatattctgtacctaagactttgtgaaagtgtgtctgtgccataatcaacaaatgatatacatcacatgcaagtcaattttatttcaatctatcataagcagtaggcgtgcacgttaagaaaattctctggatattttcataaaattacatgctcccttacctgacaaaacttgttacagctttccaaaccaaaatttccacattttgtttctaatttttaatttcaatttaataattatttaatattctatttgaatttataatatagtaaagtgttgatatccaggaattccctgaggtgtcaactgagatttatatactgacagataacccagactcacccgctctctacagtgacttctgacacgatcttccaaacagaagggatttaaattttttcttaagggctttatgttgttattattattatctcacttaattcttaattcttatcaggtggatattattttcctttttctaaaccactgtacttcagtgtagcttattattagaagtcaacattacaatgatcaaatctttgaaagccaaaggcatacgtatcaaaaagtcacaaaaatatccttaaataagctttctttagccattatataccaaaacattaattataatattttaaaatttgtatataagagaaataaacagggtactgactcagtggtgacaatttttatgaagtagcctgctaggtgcttaatagatatatatacacacagatatatacatatacacatatatgtgtatatatacatacatacacatatacatttatatgtgtatatatatacctacatacatataaccttgtgatatggcatcattgatattttctagacaattatttccccagtgtttaaagagaaatactaataggcgagcatttaaaatgaactattgtcaggcatattatttaattacatcaaaggagtttaactgtttgacactttactcttgtttataacttgggtatttaactactagtaaaaatcacaaaattttaatgtctttaaaataaatgaccctgagggattcctgaccaagtatgtctgactatatattttacctaagttgtaaataaatggaaattttccaaagacagttatatcaagtagtttaaaaagtcatgaggcagggtgctgtggctcacgcctgtaatcccagcacttcgggaggtttaggtgggtagatcaccggaggtcaggagttcgagaccagcctgaccagtgtatgaaaccccatctctactaaaaatacaaaaattagccgggtgtggtggcacgcacctgtaatcccagctactcgggaggctgaggcaggagaattgcttgaacccaggagatggaggttgcagtgactgagatcacaccactgcactctactagcctgggtgacagagcaagactcccatctcaatctcaaaaaaaaatagtcatgaattatgcaattattctaattgtatctgcacttacgaagtcagaggtctcctttttcagtccctctgatagtcccacctaagtgctgtcctgctcctgtgaacactttcctgtgcaaccaaacaggaggtgccaggttcccagaactctctaacattacagatctctgtccatctttactaaaaaaaggaaatgtgagggaaagaaggggaagaactctagcataaataatgtattaatataaatatctatattgattttcaccccccattcccctttgctaatagaaaagagtctagctatgatgtgtcccaaatttaagagtgtgatgtgaaggactgaatttttgtttgttcgtttggtgagcttttcactcgtaggtgacatcttttgtatatgctgtaaagtctcagttaatggaatcctacagtgcatttctggctagctcggttggtagagcgtgagtctcttaatggaatccttaattagctagaattttcctgcaaatggctttggatgagggaaattctataaaatgacaatttggatatactttttgttaaatgagagcaattttctctgtatgctttgtctatgcatggctgtgcagggcccaaatgacttcactgacacctgtttccaggagggggtcttcagagcctccttaggctcttgtcagtatcataaataattcctcttcttatagcggatggggttaccaaaaaaaataaaaagtagggaagagcttctccatgggatcagatcacagctttggggagtgggatggggcctctatgctttgatctatgcatgagctggggtgagaagttcccacctgcacctgactgcaatgactgtaatggctggaattgtcacctcttctccctgataggctcttcctcacctggaggatcggggctggtgggagggcagggaaggggaggccatcagccagaatgtattttctttcagttccatttcctgaggaagaacttgcttttaaaggaggaaagggacagaatcagacctaaataaaattcctgagtatgcaatatttctctttagtgtctcttcacctccctttctgagtttctttcctacatcctggctcttcattttcccaatgcccaatataatcatggttgctgaaattctcactgccttctactttcctttccccatcaattaacccactacaaaatgacccctttcatttctcgcttaagcatacatggtgggtcatttaactaagtgttaggaagaaaacaatttaaagacactaattttacagtttgcgttctgtaaaaggatacttgctggataatctaagtgaattgatggattaggtcatttgggattgtgatatatattgttcttgctgacaagaaatgacccatgaatgtctagatctatcctgtccaatattgtagctacatgtggctatctaaatttaaatgtaatttaattaagccaggcataatggcacaagcctgtaattccggtgactcaggaggcttaggagggaagatggcttcaggccaggagtttgagaccagcctcggcaacatagtgagaccctgtctctgaaaaaaaatttttttaactagctaggcatggtggcatgcgcctgtagtcccagctattctgaaggctgaggtgggaggattgcttgagaccaggagttcaaggctgcagtgagccatgatcatgctactgccctccagcctgggcagcagagcaagacccctactctttaaaaaaattaatttaattagaaactccatttctcagttgcactaactacatttcaagtgttcagtaaccatagtggacagtgcagatgtagaaaatttccatcactgcaaaaattctattggacagcactggtgcagatcattgctactcaaaatgtgatccatgggccagcagcatcaatattacctgggagcttacagaaatgcagaatttcaggcccactgcagatctaccgaatcaaaatcttcctttagcaaaatttctcaaacgattagcactggcctacatccattttatccttccttagctattagggatgtgaggtccgagggcttcaaaaggtccccggaatagcttgttccttcatccactgtgtcctattcattcttcagctaactccagcaatgagctgaaactcattcatcacccttgctgagttttcttctcaatccttattcctaattctggttctagatgagccctacctacccagtggttgtatttttgtagccagtgtgggacacaggagattggcagaccaacacagctagcctctctctagccctccctccacctctaagtcactaacaatccatgtttgttcagtttgttgacatgtggcatgttcatttgttcacaacttaatcacgggggacatttcagaaaaatgtgtactaagttaaaaccatgtttagtctcctacaacttgtacattttcattttctcttatcagtagattgtccttgttgacatagctcatgcatgaggacacatagcagtacacacacattgaatgaattgttagtcatgcaaaaaaagaaaaggaatgaaccaagatgattgcaagttaatctcatttaagccctctaaaaaggcatgctttgctagatttagatctgttttccttacactcacttatcttgatgttcacatggttaataattccttaaaatagtgcctgaagaataatatttcatattcttgacccccaaataacagtttacttaattttataagatttttcccaatgagacttattttcaggaatccttctcttaataacttttacatattgatataatgtaccaaaacacaattgcctagagatgctttagctaatttttattaataaagaggacaatatttttgtcttcatggaacttatttttaacaggaatcaaggaagaaaatattcatgcagagctatgacttagaaagttataggggctgccactatacagcacttctaaagtaaaacatcttctatctccaactgggctgtcaacatagtggactttcatgttctatggatatgaattctttaaggatgtagcccttaattaagctgtaaaaacaatgcatctctcaaccttgacatttaggatctctcctgtctgccccctctacgccccactccaattaactcatcctacatctctcagatgtaagttggataagagtgggtttgaagtttggtaatacaagtggcagttttaaaacaccaaattctttagatcagctgaaaagaagagtgagaattgaaaattcctccactagtaattgttagccaatagaatagcctcccagagcagtccccacagcacttggttgccatgggtttctctcctctcactgcctgccccagtgccatgatgtctggggcttgtctcttctatggcatcccctgattgacttttgtatagcaacctctgtgtcaagtcagtaatatgatgccattgtaataggaggccttcctaaagaagtaactgcaacttttaaaacgtgatgattattggtttttataatacacaaagcattaattttttcttatcttattttctctttattatttctttccaacttttgtttggagacatttatgttagaagaaaaactataaagttttatcattgtagagaacagagagatcaaagacagctggactgtacctgtttgtgtaattatttctgatatttttaggaaaagaagtttaacagagtaactcagactgagactgttaaactctgttcatgataaactccatattacataatataggtgaacagattaattccctccatgtaactaagatactctatttacattatttatatactctcttagttttttatgcacttccaagttttagttggaaaaatgaaaaccaagctactacttaaaagttattaaaaacttcacataaaatatttcattttagctacaagttattcattgcataggattttataaatagtctgggtatttcataggaactgcatttcaaaagtgaattaaccaaacctaaaaaaagggttacttttaaaatgcattaaaataaagaagtttcatattcagttgataaggccattaaggtaggataatgcagttacatatacaaactaaaaaaggaaaaagaatatattttgtggtccttaatgtttgattgcactattgtttcccacagcttagccgtatctatttctgtataccaagtattaagctgatatgtagctaaatatttcttacagttctggtaactggtaactagtgctgtgaaaggttttggtattgtaacattcccagttttgtgagttatatattgtatattgaagatgactagtaaattcaagtaatatatttatctacagctgggaaaatataattattttcaaatcttcaagtaagttgtatcgaatgtttttcttcctcttaagtgagataaatctcacttttatgttaaaatgtctatttatacaacaggtttctccttttgctgttattttcatattaaaatttttcttatctttttatatcaaaataattatgctggctattcaaactgccaagatgtattttagtttgcaggatttttggcagacaaaatatttaataacaaatataaaagctttgtatattttgtggcattaggggcaagaattttacctttggatttctctatgtgaggcagtgctggtgtcagcaaagtcagtaacagacagtattacttgtaatcatcaaaagaaggtttccacaagttgtataaatcagtgcatttatttattatgttgtgaaacttaagctttatatgaaatacatattctagctcttttcctttttactgctgttgtttagagtgtgtagttctgttgatgatttacttatgtacttgaagtactcatttctgtcaaacagatgcccaactattttccttttaaaaaactgtattctttactgcaatagatagcggaatagtaatagacactttgttaaaaaaataagtttcatgtttaaaataaatatttttttaaaatataaagccaaaatgaattcaccaatattaaggatttaatgtagccaagggattcagtgtgttatattttgccaatatgtattttatcttcatgtcacaacttattttctgtagccaattctcagttttagttgaagagagatctcagtgattgtactgccaatatgacattcaaatgaacattaggaatcttgaaccatggctgagcgctgttgctcaggcctgtaatcccagcactttggaaagccgagggaggtagatcacctgaggtcaggagtttgagaccagcctggccaacttaatacaaaaattagccaggtgtggtggtgggtgcctgtaatcccagctactcaggaggctgaggcaggagaattgcttgaacccaggaggtggaggttgcagtgagccaagatctcgccactgcactccagcctgggcgacagagcgagactctgtctcagggggaaaaaaaagaattttgaaccccccaaaatatcacatatctagcagttctaggttccagggtggatatttttaacatatgtttgcatttggttctgggatagtaaccgttatggataattgtttgtttctgtcaagtcggtgagattttaattgtttgaattatttctatttaaaattactctcaatttaactgtttaaaaaactaaaaatttaaaacataatggcacaacatacgacacagaataaaacacatgttttcaaggaagaagaaaaaactgttttgacttaatgtgaagcaggggtttaccaaagaaaattgctttaataagccctaactttaactgttttcttctatgttacagtgttagcggttgatgtattgtgtactgtttaagaactcataggagactaataattaatttactataattttaaaggcaaagagttttatattaattttactgttgcacaagcagttattggaagtgggggaaaaaaagaaaactggtgagagaaattacatggaaattataggaaaaaggaacttgaattggtaatttggcaaagatttgggaacaaatagtttgaacatagatttctttcaccttatatgatagaaacacaaggcacacgtgagctgtatagtgtgctgagcacacccccagaaaacaaaaaatatcacattgatgaagtccgagactgtatctagatcttagcataactagtgaattcagggagcacatcctgctgctgaaattgagaagtcagtaagaaggtagttcagatgacctaatcattcaagacatttgatggagtccacacaagggtttatgatgtggggcaaatatctgtgctttctcatctcagtgattgatgtctggagaactagtcagacacacttagctggttcctatagaaaaacaccagtaaatgtggatcagaccataccctgcagaccaaggagattttcttaaacttgctaagcctttcttaaacttgccaagtattagcaatgataattgctaaatggattttttcctttcactgaaacaacaaaacaattattgaaattcacaatacctagagatgggaacatggtttaggtttatccagttctgtaactgactttggcattggctcattgtgtcctttctacaagttatgttttggtgacttggtgtccccagttagaaatggcacacaatattatcagttgttagtacttggtaacgtttcttttactaaaggaattatataagtatgaatcatacctaattttacaatttctttcccacggtcattttggatataaagatagacttcccagacagtgaggttagaaattagaagttcaaattgatatccctgatgtttaatttaaaaatgaaagtaaagttaaaattagtagcatttgtaccagagtagattatgggtattttcatctgttatattacatgttcatattattcattttaggataggccaaaactcacttctaaaatcttcaaaaattttgaatagtttcattttttcaatacttaagccaaatgacaattttatagatgtgaatatatgttttttaaagttaagtccttcatatcttttcttagtttaactccccaaagaggaaaatgtctctttaaaccagtagttaaaaagatggagtatgtgatgttcctttctctgtactgagttctgaatgtttaatccagagcatggatcactgactgcgttctctgactgtggaatggtattctttcatgcaaagtactttcaaaacttcccataaagaaactaaactagagattgtctttattaattaatggaactctgggtatgattaagggaattaaattagaaagtagaataacctagttaaaatcattatattagttatacatgagagtcagtgaacgatgacttgatttttacatgacatttgaattctgtcactatctgattcttgacctaaaggtttctttgctaaatctgatatttattatagtataatatgataatttggagctcctgttgcatctcactgccccaaaaatgttggaatgccatatgatacagggaaaagattggagttcatcaccgtggaattttgatctgtcttaatgacacaacttaattttcatgatgatagatctctgaatgattaatccagaatgatttggtacagtgactggaagaaattgtttttctgggaatttgcttcccataatgacctgatatacaggtgaccttagtataattgaaattaattataattttaattagaacatgctctgtttacagattataattgcgcagcattttaaaaaaatatacataattatgaggatgagagaattgcaaacttgaacagttcttttgttttctctccttttacttgaaaagctttcagaaagcttttgaaagatgacacagttttcatagcaacagtatgcaaattaggtttttctgccaagaaactcataaactaaagtatggaataacacaaatgcttaatcttaatcttggctttggattttgtaagcaaaagcattttctgcatcaatttttttcagtatgcagttgcatatttcattttttgattatgtcaaaagttgaattctcattttatgctgtgtttctcattagttgcagtaaagtgttgatttcattgctgcctttcaggccttcatcatacaaaccctcaccatttttcactcctgtgcttttgccataggtttttttttgtttttggtttttttccagcaactagtttttctactttcactctttcccaccagagtggtctctctaaaacaaatttgctaaagttcttaagtaggctcttttttctctaaattacagaatagcaaactaactcctaagcaagatgagtcagtgtctatgaccttgcctctttcttcctttttagtatcctcaccaaccttccctctgttgacttttgtaatccaggaatttggaactacttatgacttagtgccttggcataatcacatgccatagatgaacatgttcaagactcagttcaaatttaactttctgtgaagccctacctgacttccctaggcaggtattttctccatgcctatagtatattgaaactttttctgttaaaataacataacatttcaattacacacacacaacctgtctcttccactgaacttctctctccccctttgtattctcagtgtctagctacacataataggactttgataaatatttttgaatgaaggtaatagaaaacccgaacttctctatatttgtgtactttcacaaacaaaggcttagaattccacatgaaagtccacatgaggtaagtgtgcattcatgagcatgtgtgcactctgggcaaaccaacagaagataaacagcaaggaagagcagttgttttgtgaaaaataatcatctgttagctgtaaatcagaaatattggccaaatcagaattcttgtttctaaaatgaggcttctaaaattttcacataactgccaaactcttatttgtaattcttaaatatgccctaaagatcatctttctcttttatagacatttagtgtatacagtccacataaatacatatactgattacctacagacaataatgagacttcagaaagaatcaaaagcaatagtgatggtggaatttttaaataatattcagctggggggaaatagactgagtttgtgtgatttcaggttatttagagttattaatgtaaacataagaaggcttgtgactcttatcaccctctatagaatataaagactaaaaataaaaactattacctctgggcctgtttttctttgggattagataaagcctttctaccatatcaccaaatactcataaaggctaacacagaaagcttttccaagttaataatttctaaaattaaatatcagggccaggtgtggtggctgacacctgtaatcccagcactttgggaggccgaagtgggtggattacctgaggtcaggagctcgagacaagtcaacatggtgaaacctcatctctgctaaaaatacaaaaactagccaggcatggtgatgcacacctgtaatcccagctactcgggaggctgaggcaggagaattgcttgaacccaggaggcggaggttgcagtgagctgagattgcaccactgcactccagcctgggcgacagagtgagactctgtctcaaaaaaaagaaaaaaaatcaaaataattgtaattaactgaaatgccctgttccttcattcacttgatagacttttctacctgctctatacttggcactcaattagattctggggatacagataaaataagacaaagctcccatctggtagagtccaagtttgttttcacagttatttttccacagtctgtttaaggtattaggaggacttttataaaccgagtgtttttcaggttacttcagagaggagtctccttccacccaaaaaaactaaccaaattattttatcataaagaggtaatcccatttttatgtccacaatttttacatttttgtatcagccaccaataattttgactgttttgtcaagtacatatttcatcaatcctatttccacagccgtacatgtgatcccagtgactgatagatctgtagaatgtgaactcacatttaaagtttattttgggaaggcatatatgccttttgatgacacacacaccaaaatatataagagctgtgcatggtaaacccacagtagaagggaaaaagtaatgctttctggtatacttcagaggctccatttgaagatgtgcgttgatgtttccttgattattttgaatgaggagtaggcggtaatatttaacaggtagcatacgtatctaagcatatagtaaatattactagtacttgtgtgccatgaggcactaatacataggtgaaacaaaaatatttttagttctaaaaaattctctagatatttatggatggttaggcaatagggttccttcatgagaaggaaaaaactgtatctttattgtcagtaagtgtggaaaaaaacccgacttgtatgtgtattcacagtttgataggcatattttgaagtcattgttttccatcagtattaagtatcatccatttctatgttctctagcaaaagaaaattcttagtgtgatacagctttactctttgtttgactttgtacaaggtccacaaaaggaggaggctcaaaagattggacactttaccctgacattcagcacattcattttatctttcgataaagataaccagaaatcatttgcctcttgtttattatcatgttgaaaacacaacagtatagttccttttgtcccttacattggaaaaggtattttaaatttagccttgccgtattatttatagttaggaatttactacattttggtagtctgttttgaaactaagcacttgtgtctgaaagatgcagataatatctatctatttattacacagtgggctctgtttgctgcagaaaagagtgaaacttttaactgcttagcacacttgccagtgaaatatacctgacagagcagaggttataactttggctctaattacttttagtaatggtaagacaacgtgagttttgtttgtttacatgctgtttacaatggcataattttaaaaatatatacaattgagatatttattgcctactattttaaagatgttttatgtgttttcacctttggaatatattgttacatttccttgtacagataattttggtggctttgttaatgtagctagtaatttttatgactactaagtgaccagttttcggtgccttttattgtgggatgcatgattatgtatttattgtacggaagtcactgacgtgtgtatttttgtactttgctgaaagtaatggttgatcctgatgtacatgatgatgaaagacatctttcccaaagggcactgccttgagatcatccttctcaaataaaaagaatgcatttgaagaaa

SEQ ID NO: 5533 - DNA, 777 bp, Homo sapiens
  ENST00000611224
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagggtttcatcatgttggccaggctggtcacttctgagctcaagtgatccgcccacctgggcctcccaaagtgctgggattacaggtgtgagccaccgcgcccagccgaaaacaatacaattgtgaagcagttctacaccatgttcgtagcagcgttattcataggagccaaaaagtggaagcaacccaactgttcactgatggatgaatggataaacaaaatgtggcacacacatataataatgggacattattcagccttgaactggagggaaattctgacaggtcactgtgaggtgaaaggtcgcattttcaggtgtcagggaatctttactgcaatttgctgacattattgaacaccaccacatttagcatattttcacataacaaaaaacactacatgtatgtacttaacattttatagggtcgatcttccttattcatggtttcagtatttgctaatttacctactcactaacatttatttgtgactccaaaatcaatacttgtatgtaatttttcacatgtgaaaaattggagttgcccaatgtgcacattcgcagctaaggttgaacctggctgtgctctgtcttcttgttttagctctcatgcaataaacaagcaccctttcatga

SEQ ID NO: 5534 - DNA, 3449 bp, Homo sapiens
  ENST00000628433
attattagaaatctttagtcatctcattccctgtgagctgaaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 5535 - DNA, 3517 bp, Homo sapiens
  ENST00000627777
gagctgaaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgcactgccgctgcactctgttttgcatcttctttggccaacctttgctttgtaatgcattgagcatgtagaaattaagggggttttgctcttaactttggtagttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 5536 - DNA, 3045 bp, Homo sapiens
  ENST00000626247
aaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaaggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 5537 - DNA, 3957 bp, Homo sapiens
  ENST00000536612
ggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaagaacacagtaggagaaaaaagagacaccaaagaaaatggtaaacatatggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacga

SEQ ID NO: 5538 - DNA, 4422 bp, Homo sapiens
  ENST00000498255
aggccttttacagactccaaatagatggtcctgagctgatactgtcattgtcaccatgatcctggagacacagcctgtagctgtgtggaagtaaacttctaaaacctgtctcttctgagagttactgcatgaaaacaggcaaggatgggtcaagttttggaccagcagcccaagttccaccaaccactctgttatacagaggcttctaagctatgcagagtgctatgaagggtttattcttcttttgcccacctgactgatatactgatgtactttttgaagaagggcaatggaatttacctagacgtcactgtggtcttgatgtggctgaagtgttttgttgaaggctctttagtcctgtactcatttagattgactctcacttctggtccctttttgtggtgcagactaaagcctcaaactctgtaaaagacaatggcttgtctcatgaagagaagtgaccaactgttaataagctttatccaaagagggtcgtggaaaacaagaaaatgcaaaagtgaggttctcttcaatttcatatgcaattaacaaatatccagagctgactgattggtgctcctcttccatgtgacttttggctggctgtatttaaggatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggcaatgatttctcagatatgacaagcacacgccacaaaagacaaataaattggacttcaccgaaatgaatagttttgtgattcaaaggacactatcgagaaagtgaaatgacaatttaagaatttacaaataatatatctgataaaggactagtatccagaacatataaagaacccttaaaattcaacaataaaaaggtttaagagcaggactggctgcctcaattgctgggagttcgattatcaacaaaatgttactggcaaacattgatccttttggtgccacgccgtttattgacccggatctagattccagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataaaggatatatatgagttcaagatggtcacctgcttctctaggaatccaagggacaacttcaattcctttaggagtttcctttacagaaaactgcgtggtgggaatccaggccaatacagaaaggatcaacaagctgatgaatgagtctcaaatgttggtgacagctctcaatcctcgtatagcgtatgacaaggcagcaaagattgctaagacagcacacaaaaatggatcaaccttaaaggaaactgttattgaacttggctatctcacaccagaacagtttgatgaacaggtaaaaactaaggacatgctgagtccaaagtgatttaagtaaatttataatgaaaataaacgtgtatataatttttt

SEQ ID NO: 5539 - DNA, 282 bp, Homo sapiens
  ENST00000489851
gatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgaaaagtgccacctttggggcatcctttgctctgagaagagaagctgaaaggctgcatgaaagccatcactcttacctacctcc

SEQ ID NO: 5540 - DNA, 4202 bp, Homo sapiens
  ENST00000379274
ttttgaacgtcacaaggaagaaacggtgcccggcgcagcttgccctggagcgtagctggagtgcggctgagttttcgctccgctgaagccggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacgatg

SEQ ID NO: 5541 - DNA, 12928 bp, Homo sapiens
  ENST00000453654
cggccagaaggagaaggacgaagcgctggaggagaagctgaggaacttaactttccggaagcaggtctcgtacagaatctgcacccctagagcaaatagtctctgtcgactgtaaagctgaaggtttgaaaaggcagtgcgagtgagctggagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttaataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggtaagtcaaaaataaaagtaggtgtccaaggattttacttttggcgaaatctgacgtctcctgagcttattttcattttgtccttggacatagcatagtgcttccctaatgtttctacatatgaccatgaatgatagtgtctctacatttaatttaaaagtctaatggtgacattttgcttatctgagtcacatttcggtaacatatcatcattttgaaagtgcggctatgacgtgctatattaaacaggaacagcctttcagtggatggggattttattaccacagtctttccatagtcatttcaaaatcaaattgttggtgggaggatggattgggttgtgagtaatctacttccatatatcagcctcagaaatggaactatcctttggatattacaggagacactgcagcagattgtttccagaagctggaaaaatatgctccaggagaatttaatcactgggcttttgctgggggatttttagttggcgggactgtcaaggaaatgtgatgacagaaatataatccttaacacaaactggaatctggctttgaatggcatcttccattccctggattgagtcaaatgtttggccaagcagtcagttatctagctgttactgttgggatgaagaactctgttttcatcaactaccatctcacatttctctaaatacttccaagtagcccagagaaaatttagggtacaggtggctatgggccaatttctaaatagctccaattgaagacataaatctgtgttatgaaaaatgatgagttggtactgtaagattcctgatgcatttggaaattttttcaaaccaaaaaaaaaaaaggcattagagtcctgtgttattcatggagaccaatatttgatatatcgctttgaaaaaagcaagtaccactaggacttgggatttccaaaataaagtgagcagaataaccacatgtttaatggcttcaacattaaaccacctcctgtagcatgttttaaaaattggtcctgggctttggaaagagctaaggccttatggtctaggagtttccatctcagcttaagtatattgtatccctactattaggacatcaggaaagcaagtgatctagtcctggtctgaagtgccatgtaactttaacagacataaaaatatgtacctatagaaatatcatttctacaaagcctactgagacagcactgaagaggcagctagcttggctgactcctctgtgtttgtttctttgtgtcatggcactgactgctttgagattccatttttagatgtggttgatagaggaatggaaaatgaagagttattaaaagacaacattctgtaacctgaaaggtagtcatttttgcaagcttatattttaatattgtgcatttaacaaaatagaacacagttaaactgtgctttatcgtattcaaggacttcataaagaataagagagaagattagtaagccaagaatggaataaataccatgactaggaattttgctttcagagcttatgtttcctctgtagatgtgataaccaaaaaccagtgcaagttttgaaacataatttagctggcaaatgcacagtgatggaaattagtaatgactgatggagagccgtacatacctgttgctccttatcctttcagaatggctgctttggcagatctgcctgtgctgggagctactcaacatcacttcattttcatctggacctagtgagagtccctttgcctaacgaatttctgaaatttatttatttactagaccccttataatattcatggctttaaaaaatgacacagcatctttattttattacatgtcaattttattaataatatttaggggtttttttaaattataaaaatggcacatgctttttataaaatgttttaataccacagatgagtatcacatccacagtcaaggcatccctttgttctggtgttgtgtcccacttcccaaaaataaatacggttaacactgatgaacactgttgcttgtatgtgatgtcagaaataccccatccgttcatgcacaagtatgtatgtatatacgcatatacatttacacacatatatagacatttatttatatacacatgcaagtatgtatactatattcatgtatattgcataggtttagaaaagagcaaacattttaaaagcatgctgatcatttgtatatgtctagtgaacaccagtaggcaaagacaggttaaacagagaagttccatttatttttttgtttccaccattgctaggcttagatctgttatggcattactacaattgcacttagcattttctattacctgtgtcataaaattcatgaccaagagttcctgtaattgtttatgttgccttccatgaagcatgaaacctaccatagccccaagacttatctatgctatgtttgtatttcaagtaaaggagagttctttcctctgtgatgcttacaccactttacaaggctgtttgtaacactaacactcagtaggttgcctagtgatatttaattagggcaggctacttccgggaaggtgtaacttcagtgtagtatgggggtctgagcagcttgtcttccttccagaaggagtagctaatgaaatcactgagaacagcatattttattcaattatgctatttaaaaatgggactttgttaaaatggctcatcataaccatcaaataaaactactaattgttctatttaaatgaattatattcattttaggaaaagaagtagaaaaacatctaataaattagctttctgattaatctttaacacttatttaatataaaatggcttctgcctgcatcttaattgaaccacctttgaatctctcaactcctttcactctgaatctcatactcagctgattagaagtcctacaggtccttctctgccaggtctgtcagatcgacttggaccctacccttttctgtgtccccagtcatccattatctcttgtctctctaagttttgggccatagcggcagtcctgtccctgaactttctgcctactactgtcaataattttgtcacgcagttgcaaaaatcttccccagatattatgctcaaaatacatcaaaatgaaattaccctctgggacaagtataccttttactcaaaggacacatggatgtccactgaccttgatcatcttatagaattatggcaagcatgattctgaaaatctatcaggtttagcaaatatctgtcttagtcccatgagggtacacaatcacggctgctgcttcctcattcaacaatgtaagccacatgcctctttgacggcacctggaggactaggttatagattttacactgctgagggccatctttggttttacactgtctcctcacagcttaatgagaaacctgaaaataagaaccaagaaaagagtcatgcccttggacaacctcctctcccaggacactgagatttactgaccaggtcccagaaagaaagcagaaaaataattcttaggctcttgtagcatggattttaaaatagaaacgtgaaaattgaatggtatcttcataatgcatagactccagagtctatttacatatgtattcagttatgcatgtaatcatatgtccatgaatcaatcataagtgcatgtatttaatcattatttgaaaaatatttgtcactctgaggcaggcatcatactaaggatataacaatgaatgtaatagacaaaactcttgatttcatgaagctggcatctagaagaaaagacaaattccaatgtgataagtgcagtgcaggagaaccccagggtgtccagcatgggctggaaattcaaccaaggctttattgtaccagccactcattagccagcaatgttttggttcaatgaaaacataagtaggaagagaataatattttgcatttccattttactggagtcatagtagatttctaaaaatgtatctgaaactaagattttaaaacaagacttagaaacactattaaaatgaaagctaagactgatttattctagctctcaggatagaactaggaaaaataagcagagttttcagtgggttttgactaaatataaagaagatgaagtacaaataatatgtaatagtggagtggatatcacagttataaactttcagcctctgttagcatttaaacagaggatacctgaccactctgaggggtgttgtgattaggaatatgtgatttgagggggctaaaattagatgctgtgatttttcaaaagatattttttaatggctttgttgaatggcaggattttattttaaaaactcatgaaaatcttgatttttgatttgttaaactttgctttataactgagaattttaaaaatatctaggggaatggccgttagttatcatttaaaaaattttaaactaagcatgaatttaagagctagtcaaaagaaaacatactaaaaggtgtaatttaattaaaaatacttctggaagcttataaattttgatcagtattcttagtcattgtcaagtaaaattctattagaaatctgtcttactgtccatccaatataaaaaagtgctgtggtttgatattctaagagttaagtgtaatctagtataaccacagaagaaaattctgcctgtaaggtatttgggagccaagtaaatgtacatgaaaggcaatcatggaaaactctttggcttctgccaccagcgtggcaaccacaagggaggtcctacccatggaaataagaaaatagtgatccaagttttcacccaacttttgaaatttcaatattttgagccaaatgccttctgaaatgggaggctttgatagtgggaaatactgaaattatcttttccctcagacctttagtgaaacacacatatagttttcactctatgacagtataaacaactcaaatctatactgtttgttaagaacagtttcaagaattaaaaagtgctttagcgttatgatgtattgacatgtttgagcttcagttggggttcaaaacaaccccaacgaggtgaataatgcatataatacattttagatgaatgcactgaatctcagagcagtgaattcagcctgtgcagattcatatagcaaatgatagtgctgcagccagaactgggtctttagaaattacatattaacatgttttctaagtaagtcattttccatcattgccttcaaggatgttttatatcaattgttcagatttccataatatagaagttgcctccatgaaaaaaaaatgtttacctaagtttccacggaaagaatgagttagaaataagggagaatgtgaaatcaaaaagtcagagtttttgctgtcggagagaggcttgtcagcttgtacatagttcaagcaaagaaaagtctaatgtttgcataccagggtggatttcaagagaagaaattaacagtgagcgttaatggcttctttaacttatttgtgattctcagcatttaaaaaatgttagtcctatttttcttcctttgaagtcactattaggatgatataatttctgaatgctgcaacaaaaaatgttaaaaatggccctgacatccaagactctattgctctaagtttatgggtgggtatgcaagctaagtgttatgataatacatagtcatatacatagaggtttaatacacctatgggaaattccggcatatttgaagtagagaaaaacaaacaggcttgaaatgtccttcagttcagaatctcatactttacaagggacatttatgggcagattggtgaatatgtagaaggaggatgtttgatctggaaagaagacaaaattggattaggaataagaatatgtagaggagttaggttaagtaggactgttagtttcaaattctgcagggaagatgatttgtagaataaaataaggaaagaaaagagcagtaacacatgaaaaggagttagctttattacttataaggatttatttttcctaaacattgcatccagaaaaacagtttgggctttctgaaaaacagtgaagttgttatcactgtttcttctagtagttaagtgaagattgaacaactaactcagagatcaaaggcatatctttaattgtgagagatcttggactagaaaaactctgtgagattttcttggtttaaatgtctataattttagactggaacagaactcaatttgagcctatttttttcccccaggttcctgccaactagatagcaatgaaggcattttttaaaaaagcttccatcattgcaaatatatcccaaatcacttagcagcggggatttcatgaccctaaaaagttgccttgcttacacaaacacacctatgctttagtagaaacatatcttttttaggagatttgggaattggctagcatttttgccaattgttagccaatttaggagatttggaaattggctagcaattttgccaattgttagccaattcccaaatctcctaaaaaagatatgtttctactaaagcaaaaaggtcacagattcaggagtcaaagtgaaaacaaaggatttagtgttctttcccctacttactacccatttgttgtttgggatgtagagtcaggactggagaagagggtgggaaattctatatcctctgccaatacagaggcatggaggcactttctataactttgtgtcatgaaacaagacttaaccccatatcagtagactaatgtttctgtcatatttctgtctaggtggattacagttttaattgcccatcatcccttaattctgtaatacagcttgagttcctagatttcaggttgactgggtgagggaggaagtcacttgaggtaattttaagaaatgaatccatatccagagtcttgcagaaaagacctgcttctactccaccttctttcttgttctacttcttgcctctggtttgggggcataaaagaggggcagagttgtgaggaaaggaaaaaagattctcaaaagtagtacaataagaagaccctagtagtaacacaaattctcatggtaatctcaaacaactgatagtgttagcagatattgaaaatcaaactcaggaaacatacagaaagattaaatttgttcaaagtggcttcaaggggtattagttgtgaaaatttcagtttatgcagcatagaagaattagattgtgtgtggaacttgggggaagtagggtcagctaatagaagaactttttaatggagctttccaaaggacgaggtggtttttggaaggagtttgtccaacctcttataatacattatgcctgtccacaaacttgttctggtccctgataaagtttgaaaaaaataaggaatatttagggttttttcccacaaatctcaatatattcacttaaaaattcagagactgtgaccttgttattttgggtttaaatatacattttcctcttaaaaatgatagatatatgtttacaaattgtctttactcttcacttataaaacacacacatacagataggatagtcctgtcagtttaccctattttttgtttcaaatttataggtaatttcaaatttataggtgttggtgagatttatcacttttaagataccatctagccttgatatttgttgtaccttctatatgcaaccaaatggctcctgatctcctgatcttctggagatcaaagaatttttattcgccactctccccacccatcattggttggattgagactctaattacatacaagcataatttccaatgcaagtagaactttgatgctctccctgacttaccgattataagttgggaaagtttggattcttgccatcctggggaaggagatttagaactctcatagacaaaatattctaacacaacagaatattttgcaaaacacatctttgaaaagtcaggggccaaaatagtctcagcaaaggttagcttggctgttttttaaaattaccaatagttaagtgggcaaccatgaatctgaatattatacagaccaccactgactgaaactgaggaaaaccattcttgtgaaaaactaaggaatagaggacaatctcagttctaaaagaatgaatatatttgatttaatttgatttctgagtgggaaaacgttcccaggcatccagggtacccttggctgtgggtattccactcgcaaaggctacatctgtatgaagagttgcagtcacattataaagggctttttcatgatttctgattctgccctatcacatcccagagccatgcttttgcaaagctgccagctggcaggtggaatccataaacaagtagcagctgtggcagtagaaagattaaagttttatttccaggtaaaggaggattcagataatacgaagtggagggagggtgggtgggggggggggggtgggatgggaaagggaagaatgaagttttttgtaacaaagtcataaagtatttttccctaattttcttgcatttcctatttatataaagtatcttgatcactgtgttgcactacagagattttcaatggagttaatttgggagactgaactaatctctgaaaaagaaattgactagttacagttactttttggacactttttctgtattgtgaattgtgtggaaatgtacagaataaaaatgaagaaatgta

SEQ ID NO: 5542 - DNA, 3223 bp, Homo sapiens
  ENST00000494390
agtaaatcatacctttgctcacttgatttgaatgaagattcttgtctaccaacagttttaggaaatagatggaatttgtgtagcatcaccacttcacggtaaaacagaagaaaaagatgaggtttctgcagttgtgatgcagaccgttgaaatgtgcctggagagaatgcccaactgggaaatcggttttcattcgggactacgtaggagtgtaacagaggacaagcatcatggctcaagaagcagggaggaaagtggaacctggggaatgctgaccaggcatgaacattcttacatgttcaccataggaaaaaggtgtgagcacatgatgggaggctgttctatccaggaaagactggattccacccaactgtgacaaaggtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttaataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggtaagtcaaaaataaaagtaggtgtccaaggattttacttttggcgaaatctgacgtctcctgagcttattttcattttgtccttggacatagcatagtgcttccctaatgtttctacatatgaccatgaatgatagtgtctctacatttaatttaaaagtctaatggtgacattttgcttatctgagtcacatttcggtaacatatcatcattttgaaagtgcggctatgacgtgctatattaaacaggaacagcctttcagtggatggggattttattaccacagtctttccatagtcatttcaaaatcaaattgttggtgggaggatggattgggttgtgagtaatctacttccatatatcagcctcagaaatggaactatcctttggatattacaggagacactgcagcagattgtttccagaagctggaaaaatatgctccaggagaatttaatcactgggcttttgctgggggatttttagttggcgggactgtcaaggaaatgtgatgacagaaatataatccttaacacaaactggaatctggctttgaatggcatcttccattccctggattgagtcaaatgtttggccaagcagtcagttatctagctgttactgttgggatgaagaactctgttttcatcaactaccatctcacatttctctaaatacttccaagtagcccagagaaaatttagggtacaggtggctatgggccaatttctaaatagctccaattgaagacataaatctgtgttatgaaaaatgatgagttggtactgtaagattcctgatgcatttggaaattttttcaaacc

SEQ ID NO: 5543 - DNA, 3895 bp, Homo sapiens
  ENST00000288490
gatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 5544 - DNA, 4070 bp, Homo sapiens
  ENST00000446122
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 5545 - DNA, 4163 bp, Homo sapiens
  ENST00000424189
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatattcatcaggtgcaaactgcggacctgcggcgagtgtctgctccccccggctccttcaccattccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 5546 - DNA, 582 bp, Homo sapiens
  ENST00000477835
atttacaaaatccagatggattatgtctcaacagaagctgttggccggggttcccagagtcactaggataaagctggcagcttggcttttcctaaagggtccttcctcctggctctccgggtcaccagtctcttcagaagatcatggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagc

SEQ ID NO: 5547 - DNA, 628 bp, Homo sapiens
  ENST00000486153
cctaaatcaaatagtagtagcttttaaaaaaattactaaacttaatcaacactatttggaaagggggctagagtcagatattatgatcagttgatggctagctcaaggaatttttagaaatccccttccctacctccccagaatgtaccctacagccaaagtctcagcagcctacagggaaggaggctgaggagcaccctacatcagctcccctcacccattccctgctgcctccaacccctttatgggtggtttcccatttcatctttgatttaggggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatg

SEQ ID NO: 5548 - DNA, 632 bp, Homo sapiens
  ENST00000497321
gaacatttgcactttgtgatggagatttcccaagatgagatttttattctggacccagatatggtggtgtcacagccggcggggacacctccgggcatgcctgacctggtggtggaacaagcctcggggtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggca

SEQ ID NO: 5549 - DNA, 1127 bp, Homo sapiens
  ENST00000460662
ctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctaca

SEQ ID NO: 5550 - DNA, 922 bp, Homo sapiens
  ENST00000470895
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaggctacactgatgaacctgtttctaagatcctgtgtcaagtggaagatgggacagttgtacagctagatcgctggaacctccatgt

SEQ ID NO: 5551 - DNA, 551 bp, Homo sapiens
  ENST00000483619
aaagacttgagaacagcttatagatattgacggcagatgaagaattttcatgtcttttcagaaatggttagcagccactcataacagtcctgtgacgtcacagaaatcttgactcctgcttgtctttctcgttctcctttaagcccttccctcctccttttcatataggaccttaacacaagagggtcaggaagagaagagaagggttgctcacaggaggaaagaaggcaaggggtagctgttactttacctggtgggccatgtgtcgctacaaatcaggtggtctctttggaggagatgccacttggtaagggaggcttcctgagcactcgaatactactagcaactcagaatgtgggaccgctggaaggaaaaacacccctggatggggcgaaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtct

SEQ ID NO: 5552 - DNA, 650 bp, Homo sapiens
  ENST00000475388
agcaactcagaatgtgggaccgctggaaggaaaaacacccctggatggggcgaagagttctgtgtcatgattttggatttagtggaaaaagaacagaggagattttcttgttaccttaattttcccaacatggaagatttgggaatgaagaaggacactgcaaagagtgaggcctaaaatggaaaccagtcatgatttttattttgctactttctttacggacacgaatgcacacagtgtagagcagccttaactctgaattggaacaaggtcgtgtaagtgccaggacgttatttccagaagcccacagctgctgattcctacacccagtgatttccactgccttttcatgattctggaattcccaagaacagtgtcatcttattagaaggtatttcccagttcgagttggagacaaaccaaccttccctcacaggctgagtccttctggtttcactgccaaagcttccagactcacccagggtctgttagacatatttgaatgaatctgtcagattgttcagtcgttaatgaggtcacactttccatgaagaccatagtggcgtcattttgtgtaccaacaattgtatcaagtcatgatgattttttaaatatcattgaaataatcattaaaatattattgagataaa

SEQ ID NO: 5553 - DNA, 2799 bp, Homo sapiens
  ENST00000614521
aggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttga

SEQ ID NO: 5554 - DNA, 3338 bp, Homo sapiens
  ENST00000434391
gcagcgcccaaagatgacgtgttctgccagcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagctccttgccttctcccctctcagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 5555 - DNA, 868 bp, Homo sapiens
  ENST00000427245
acgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtcgagacaggtttcaccatattggccaggctagtctcgaactcctgacgtcgtgatctgcctgcctcagcctcccaaagtgctgggattacaggcgtgagtcaccatgcccagccgattcagggatttttcaaaaagaaaattattaattattgtcaacatagtggaatcctaattattaaaggtggagagacttttgaagccatttaaa

SEQ ID NO: 5556 - DNA, 297 bp, Homo sapiens
  ENST00000527611
gaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggtgagcaatggcccagagcaccggttggccttctggtcagttggataatcttatataaaaacctgttattaaagttgatgatgttaagtgcaattcatgatgttaagtggaatttagcaaggaaa

SEQ ID NO: 5557 - DNA, 656 bp, Homo sapiens
  ENST00000374186
gtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagctccttgccttctcccctctcagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtaagatgctatcagaggggagagcatgttcttccaccacccccagccttatcctaacccttgaaattctgttatctgaggcttacttaagggacttgcaactctttttaatgttagttagatatcttgggtggcaaatatcagaaatacaagatagtctttcattctttatttctaactttttaataaaaaagggggcatttattt

SEQ ID NO: 5558 - DNA, 1235 bp, Homo sapiens
  ENST00000525682
actgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaatgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcacca

SEQ ID NO: 5559 - DNA, 1403 bp, Homo sapiens
  ENST00000236342
actgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttcttttt

SEQ ID NO: 5560 - DNA, 1072 bp, Homo sapiens
  ENST00000526219
ctgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataa

SEQ ID NO: 5561 - DNA, 1148 bp, Homo sapiens
  ENST00000374185
gaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccaggtatcccgagttgttttgcatggtaattgttaaggaaaacaggcctgggccagcatggcagctcacgcctgtaatcctagcacattaggaggccgaggtgggcagtccacttgaggcaggccaggagttcaagaccagcctggccaacatggcaaaactccctcttttcaacaacaacaacaaaaaagcaggcctgtaccaaaccataaagcccctctgtgccatgtacttggccagaggtctaattaggggagcatgtggaaagatttaaggggatctcccaaatttagagattaggattggcttattacaacctgcttcagaactagagttcaccacacaccaagaaaccccagagaaagagcaaagcagatgacaaagccatgttattattcctttacaaattataccctcctggccctttggtagtgtttttccaagaatgacttttcatgaatgcagtttgttggggctagagttctttaggtctctcatgttctagttccacacaagatt

SEQ ID NO: 5562 - DNA, 717 bp, Homo sapiens
  ENST00000487944
gccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgaggtgggtgtgtatggcagagcccaaagtgaacagtctgtggagaggtagattatagctagaaaaccaggctctgagtttgctgtggttggagagtgttttttgtatctgtctctgtgttttattgtttgcttgctagctatagatctcatcttgacattggccagacgtggttgcttttgcctctaatcccacactttgggaggccaaggcaggaggattgcttgagcccaggggttcaggactagcccgggtaacatagtcagaccctgtctctacaaaaaaatttaaaaattagccagacttgatggtgcacacctgtgcccccagctactcaggaggctgaggtgggaggactatctgagcccaggaagcttgaggctgcagtgaatagagattgtgcccctgtactctagcctgggtgacagagtgacaccatctcaagaaaaaaaa

SEQ ID NO: 5563 - DNA, 3245 bp, Homo sapiens
  ENST00000360009
cgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 5564 - DNA, 582 bp, Homo sapiens
  ENST00000533087
gagctaatcaggtgccactgaactgaagggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgt

SEQ ID NO: 5565 - DNA, 496 bp, Homo sapiens
  ENST00000531312
agctaatcaggtgccactgaactgaaggggtgaactagaggagaagaggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatct

SEQ ID NO: 5566 - DNA, 573 bp, Homo sapiens
  ENST00000525165
gctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcg

SEQ ID NO: 5567 - DNA, 492 bp, Homo sapiens
  ENST00000525326
aatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatccta

SEQ ID NO: 5568 - DNA, 581 bp, Homo sapiens
  ENST00000525546
aatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgc

SEQ ID NO: 5569 - DNA, 516 bp, Homo sapiens
  ENST00000528557
aatcaggtgccactgaactgaaggggtgaactagaggagaagagggtgactgggcggggagcagctgcgggagaagcaaagggacgactgagggaataatcaggagaccactgaggcgtgaaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtaagatgctatcaga

SEQ ID NO: 5570 - DNA, 548 bp, Homo sapiens
  ENST00000526278
aactgaaggggtgaactagaggagaagaggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagctccttgccttctcccctctcagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaa

SEQ ID NO: 5571 - DNA, 705 bp, Homo sapiens
  ENST00000436153
gaaggggtgaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtgga

SEQ ID NO: 5572 - DNA, 589 bp, Homo sapiens
  ENST00000529688
gaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagctccttgccttctcccctctcagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggat

SEQ ID NO: 5573 - DNA, 556 bp, Homo sapiens
  ENST00000530781
agaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgag

SEQ ID NO: 5574 - DNA, 559 bp, Homo sapiens
  ENST00000531955
cacattgcgttataaaactctgggtggtaaaagattataggcttagaccagtgtctttggattctaatgctggctgctctccatagtccatctgattccccagaagtcagttatagctcttcgcaaaccttggtgacttcttattttctttcttgtttatccaagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtaagatgctatcaga

SEQ ID NO: 5575 - DNA, 595 bp, Homo sapiens
  ENST00000525410
gtctttggattctaatgctggctgctctccatagtccatctgattccccagaagtcagttatagctcttcgcaaaccttggtgacttcttattttctttcttgtttatccaagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagctccttgccttctcccctctcagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgat

SEQ ID NO: 5576 - DNA, 703 bp, Homo sapiens
  ENST00000430232
attacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcag

SEQ ID NO: 5577 - DNA, 2673 bp, Homo sapiens
  ENST00000431933
ctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaatgatatctctgagtctctgcttgataagtgcctctataccaaccgctctcctcatcctgacatcttgatacggacttctggagaagtgcggctgagtgacttcttgctatggcagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 5578 - DNA, 629 bp, Homo sapiens
  ENST00000416052
gcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagcacccagggagcctcctgaccaaggcctggaagaagcccttccagcaagacggagagctctacggcaactgttcaagcccgaagtcctcatagctccacatgtaattcattgtaatagcagaagagaagtattcttgaatgcctgggattattcaggagccgggggggacagtccagaattctcatttgtcatccttattcatgcagtaaacctttattgctgagagacagcaaa

SEQ ID NO: 5579 - DNA, 3917 bp, Homo sapiens
  ENST00000439211
agtcccagacagaacctactatgtgcggcggcagctggggcgggaaggcgggagctgggggcgctgggggcgctgcggccgctgcggccgctgcagccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcctggcgaggagcgcgagcccgcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataa

SEQ ID NO: 5580 - DNA, 1719 bp, Homo sapiens
  ENST00000505337
gcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaaataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgtt

SEQ ID NO: 5581 - DNA, 1474 bp, Homo sapiens
  ENST00000511032
gcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataagatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagc

SEQ ID NO: 5582 - DNA, 1447 bp, Homo sapiens
  ENST00000504396
aatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaag

SEQ ID NO: 5583 - DNA, 994 bp, Homo sapiens
  ENST00000513048
aaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggtaaacagaatctggtgattatgggtaagaagacctggttctccattcctgagaagaatcgacctttaaagggtagaattaatttagttctcagcagagaactcaagaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgcta

SEQ ID NO: 5584 - DNA, 545 bp, Homo sapiens
  ENST00000508282
ccaagggataatgtttcgagtaacgctgtttctctaacttgtaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaa

SEQ ID NO: 5585 - DNA, 582 bp, Homo sapiens
  ENST00000513314
agaatgaccacaacctcttcagtagaaggtaaacagaatctggtgattatgggtaagaagacctggttctccattcctgagaagaatcgacctttaaagggtagaattaatttagttctcagcagagaactcaagtaagtaccttaacataaattcaccacaagaaaatcatgtctcatagtggagatcagtatatgataaaatgaaattgtataaaaggagctattgatgaagctgcttaatatcacaaaggtgattatagaaaattaataagcagttatttatactacatgacaataacttattctactacctgagtaattgatttcatcaccttgaaaagttacattaaacattaaatagctcactgtggtatcagatttgcaagttatcttgaaccatcattcagtaggcccaaatataaattatacagtgtaatcaataacctgtagtttcacataaagtcaaaacaactattttttgggacttgctaaaattaagtgatgatcccctttctggacccaaccctaaatgcaataaaatgtgaattttaggatgggctgaaatgggtcataatcttct

SEQ ID NO: 5586 - DNA, 4386 bp, Homo sapiens
  ENST00000375765
atttaagcaggagcagcagcctctgcagcagttggcacatctgagaaggcagagattgaagagagtaggaggagcgtgcagcggcggtgacagtgccaggccggagcggctcaggccagcgcaggtgcaggggctgcgagcgggtggagcgcgagggcgctgggcgcagggagcacggccggtgggcggtgcagggcgcacggcgggcgagcagctgacagcatcgtcacggcggcgggagggagtgcgctgcgcctgcctccgggaggagccgcatccacacaccctgcgctgccctgtcctgcgcgagtggagctctgaagaagctctgagcggagttgtgttcttccccaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggccttggcccgcacatggaagtgtgccttcatggagacctcagccaagctcaaccataacgtgaaggagcttttccaggagctgctcaacctggagaagcgcaggaccgtgagtctccagatcgacgggaaaaagagcaagcagcagaaaaggaaagagaagctcaaaggcaagtgcgtgatcatgtgaaggcccttcctgcgggaggagcagctgtgtgtccccggcacctcactcccccaaaatgacacccaccgtcgtcagggtagcatgtataatgcccacgtgttaaacattgcatttaatcgagatgcgtcctattgtccttaagagggcgtttcacaccaccaacagtaagccacccactctggagtcacagaatctgccaggcggttcaagtgaaaaccaacacactcagcatccctgggaactgagaggtgccagcaattgctgaaggtggcgatgaacacccgaaggtgggagggaggactggtacccacaaagcaacatgtaccgagaggactaaatgtcatctacgtgcatgtgagagcgtgttaacctagagttacctgcaccaaccccagacagaagccaatcacatctttgggggaggggaggggcaggaagaggtgagaagatcagatggtccaaagtggaccacacttggtccattttacacttttttaaaggggattaaaaaacacagcctctcccccaaagggtgtccgttcttaattcccacctggcctgttaggagccttgctaccctgaggggatgtgttcaccttacctagacctagttaggaagtatcattttaagctattagagtatttatcttcatgtgcagggataagtgcactaacagtgtgctgctctgtcggaagttcttcagtttttaagtgaggatatcgtgacagtattaaaacatcgcaataatgttcctgtgtgttatacatcgagggttttagaaatgtgattttcttcttttgacctgtgaggagtataacttctttcagccctcagattttaaatacaagcaaataaactcactatttttagacgtttttttcctccaaggtggttttcttctcttaaataactcgatctgtacccagctgggtagcagccagcaaaggccatcagacaaccagaagcacatccatttttgtagtgtcacaaacatgtatatgccacactttgcaccttaatgaaatactttgaaacagaagttattcactgtgtttttgatgatctatctgtattggaaatatgttcctggaaaatgcatttaaataatagtaaattctcttgcatgttccattatacgtgtcttctaagagctgttcaatacagtattcactctagaaacaattatctttttctcttaatgattttgtgtgcatctttaatctttcaagccaaattacagctatttcaggtttcctgtgttagcttggggataggatggtggctggagacaggcaggcttctctgccctgggaagagcccactcagcttaattgctctgccatcgtagagcctggttggacttggcttcctgaaaactcccactgatagtgcctgttagatctcctgtttgtttcagttggcagaacatttactggccccaactgtggcatcatcctctcagcagtcttcctgtcacccgcctggcaggcagaaggagctgcagtcccacgtgggcctgcctgggggggtgggggctgcatggctgttgggtggcagtgtcagcacagggagggcttaagttggggatgtttgaccaggccacctcctgcaactgctgtttctcctgtccctcctatgcagggcttgcagcagcagcagtgtggccatctccatcccccaaagcacacttgctctctcaatatgtcctagttttcttcagccttttctggttcagttcccttgtcctgatctcatcctctctggtctcccaataactcacccttgggatgtgtttagagcgtgggaggtgcctttgagaactgcttgactccatgatctcctagaacaaaaccgccctgactttacagggggaacactcatgctgagctgagaaagcagagaagtggcgtgggagccagctgggggtgaagagcatttgggccagtcccgtggcccccttcagattcctcaagcaggattgttctgttctaaaaagctgttgcacagcattcgcaatgagatctttagttggcggattttctggaacatttgtttttcaacttgtcccgacattttttttctgtttctattctgagagagagatgatcaagttttaatttgggtataggttaaatggaagaagaaacagaacttcatggccaaagtagacctatagattttgattgggttctttgttaacagtagaatgcgatctttgccactgactgtagtattaataaggttttaatgtgagatattcctgcaaaccatcccatttctactgattgtaagtcagaatttcttttatccctttcaaatcagtttctacatgtttaagtgttcagggcttcatcagcatgagaagtttgtaattactgaaagtctgatttcattcaggacacattttttccttcatattttttctgtgaatttataggctaggaaggctattgaagcctcaattatgggtcttcattttgagatcgttttctatgagctgaactgaggatatcaatggttatctcaaaatcgtcttttaggagatccccaattgactcagagtttgaggagttagtatcacagaattagatttttttaaagcatttgtacgtttccattcccaaatatgtagctgtggttcttgaaaacacatcctacattgcatatgggcatagcagtttttgacccaggcagaataagttaatatttaattaaatattgctttgaagatggcgctctgggcatgagcatggggctccatgacttcccttctatccccatgagcccctcctccatccagcgacaagccatgggcatgcatacaatgcagcaagaccaacacaagagcaatattgaattgttcattctatctaaaattacatgtatataaaatatataatttatcttcctgcatttttgaagtataaagtcataaattgtacatatctgtaagctagtatatttgtttcactgtttgtaatatttaagaaatgctcattctttgtagaacaaaaatgtattaaatattttaaaaattgctctgtgatacttaatttttttccccaaaatttgtaatgtgttgcttctacataagttctctggaaatatctacaactaataggacacatgtaaatccttgaagacacatcctggaattcataccccacaaggacagtgtgtatacaaagtatttgcagagcatgacttttatatgtgtgggatatcaatgtgtatatttatatttaaagtgtatttattgttacaagtctattctctattatattttatttactctgcggttataaaaatcacccttgcatacaagtttctagttgccagtgatgttctggaaataatgggagatattacaataaagctacagttatgacaccctg

SEQ ID NO: 5587 - DNA, 565 bp, Homo sapiens
  ENST00000636786
acaccctgcgctgccctgtcctgcgcgagtggagctctgaagaagctctgagcggagttgtgttcttccccagagtctcgtgctgtcacccaggctggagtatagtggcacaatctcggctcactgcaacctctgcctcctgggttcaagcgattctcctgcctcagcctccagagtagctgggattacaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagag

SEQ ID NO: 5588 - DNA, 576 bp, Homo sapiens
  ENST00000637905
agtgcgctgcgcctgcctccgggaggagccgcatccacacaccctgcgctgccctgtcctgcgcgagtggagctctgaagaagctctgagcggagttgtgttcttccccagagtctcgtgctgtcacccaggctggagtatagtggcacaatctcggctcactgcaacctctgcctcctgggttcaagcgattctcctgcctcagcctccagagtagctgggattacaggcacgtaccaccacacctggctaattttttgtatttttagtagagatggggtttcaccatgttagccaggatggtcttgatctcctgacctcatgatccatccaccccagtcttctaaagtgctgggattacagatgtgagtcaccgcgcccagacaagaaggatctcttttaattttcttggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacc

SEQ ID NO: 5589 - DNA, 12614 bp, Homo sapiens
  ENST00000267889
cgccgccgctgccgccgccaccgccgccgccgccgccgccgccgcggcttcagcaccagcgcccggacagcggtgccgcccacgggcatggacggtgacagcagcagcagcagcggcggcagcggtccggctcccggcccgggtccggaaggggagcaacggcccgagggggagcccttggccccagacggcggctccccggacagcacccagaccaaggctgtgccccctgaggcaagcccagagagaagctgctccctccacagctgccccctggaggacccttccagctcttcaggacccccaccaacaacttccaccctccagcctgtgggtccatccagccccttggcccctgcccacttcacctatccccgggcactgcaggaataccaggggggcagttccctgccaggacttggggatcgggcagctctctgctcccacggctccagcctcagcccttctccagccccctcacagcgcgatgggacctggaagccacccgctgtgcagcaccatgtggtcagcgtcaggcaggaacgagccttccagatgccaaagagctattcccagctgattgctgagtggccagtggccgtgctgatgctgtgtctggctgtcatcttcctctgcaccctggctggactgttgggggcccggctgcccgacttctccaagcctttgctgggctttgagccacgggacacagacattgggagcaagttagtggtctggagagcactacaagccctcacaggccccaggaagctgcttttcctttccccagaccttgagctgaacagctcgagctcccacaacactctgaggcctgcacccagaggcagtgcccaggagagcgctgtccggcctcggagaatggtggagcccctggaggacagaaggcaagagaacttcttctgtggcccccctgagaagagctatgcaaagctggtgttcatgtccacctcctcgggcagcctatggaacctgcatgccatccattccatgtgtcgcatggaacaggaccagatccgctcccataccagcttcggggctctgtgccagcggacagcagccaaccagtgctgccccagctggtccctgggcaactatctggctgtgctctccaaccgctcctcctgcctggacactacccaagctgacgcagcccgcacactggccctgcttcggacctgtgccctctactaccacagtggcgccttggtgccctcttgtctgggacctgggcagaacaagtccccacgctgtgcccaggttcccaccaagtgctcccagagtagtgccatctaccaactcctgcactttctgcttgacagggactttctgagtccccagaccactgactaccaggtgccttccctcaagtacagcctgctcttcctgcccaccccaaagggtgcttccctcatggacatctacctggaccggctggccaccccctgggggcttgctgacaactacacctctgtcactggcatggacctgggcctcaagcaggagctgctgaggcacttcctggtccaggacacggtgtaccccttgctggctctggttgccatcttcttcggcatggccctgtacctgcgctcactcttcctcacgctcatggtgctgctgggggtgctgggctcactgctggtggccttcttcctttaccaggtggccttccgcatggcctacttccccttcgtcaatctggcagccctcctcctgctgagcagcgtctgcgccaaccacacgctcatcttcttcgacctgtggcgccttagcaagagccagctgccgtcgggggggctggcgcagcgcgtgggccgcaccatgcaccacttcggctacctgctgctggtctccggcctcaccacgagcgcggccttctatgccagctacctgagccgcctgccggccgttcgctgcctcgccctcttcatgggcacggctgtgctggtgcacctggcgctcacgctggtctggctgcccgcctccgccgtgctccacgagcgctacctggcgcgcggctgtgcgcgccgggcgcggggccggtgggagggcagcgcgccccggcggctactgctggcgctgcaccggcggctccgcggcctgcggagggcggcggctggcacctcgcgtctgctcttccagcgcctgctgccctgcggcgtcatcaagttccgctacatctggatctgctggttcgcagcactggcggcagggggcgcctacatcgccggagtcagcccccgcctgcggctgcccacgctgccgccgcccggcggccaggtcttccggcccagccaccccttcgagcgcttcgacgcggagtatcgccagctgttcctgttcgagcagctgccgcagggcgagggcggccacatgcccgtggttttggtgtggggcgtcctgcctgtggacactggcgaccctctggaccctcgtagcaacagcagcctggtgagggaccctgccttctcggccagcggccctgaggcccagcgctggctgctggcactctgtcaccgggcccggaatcagagcttcttcgacaccctgcaggaaggctggcccacgctgtgtttcgtggagaccctccagcgctggatggagagccccagctgcgcccgcctggggcctgacctctgctgcggccactcggacttcccctgggccccccagtttttcctgcactgcctgaaaatgatggctctggagcaaggccccgatggcacccaggacctgggactccgctttgatgcccatggcagcctggccgccctggtcctacaattccagaccaacttccggaacagtccggactacaaccagacccagctcttctacaatgaggtcagccactggctggcagcggagctgggcatggcacctccaggcctccgccgtggttggttcactagccgtctagagctgtatagcctgcagcacagcctgagcactgagcctgctgtggtgctgggcctggctttggcgctggcctttgccacactgctcctgggcacctggaatgttcccctcagcctattctccgtggcagctgtggcaggcaccgtgctgctcactgtaggactcctggttctcctcgagtggcagctcaacactgccgaggccctgtttctctctgcctcagtgggcctctcagtagacttcactgtcaactactgcatctcctatcacctgtgcccacaccctgaccgcctgagccgtgtggccttctctctgcgccagaccagctgcgccacagccgtgggggctgcagccctgtttgcggcaggcgtgctcatgctgcctgccacagtgctgctctatcgcaagctgggcatcatcctcatgatggtcaaatgcgtcagttgtggctttgccagcttcttcttccaatctctctgctgtttcttcgggccagagaagaactgtgggcagatcctctggccctgtgcccacctgccatgggatgctggtactggggaccctggtggggagaaggcaggccgcccacgaccagggtcagtgggagggatgcccgggtcctgctcagagcaatatgagctacagcccctggcacggcgtcggagccccagctttgacaccagcacagccaccagcaagctgtcccaccggccctcagtactctctgaggatctgcagctccatgatggtccgtgctgttcccggcccccaccagcccctgcctccccaagggagctgctgctggaccaccaggcagtcttcagccagtgccctgccctgcagacctcctccccctataagcaggctggccccagccccaaaacccgggccaggcaggactcccaaggggaggaggctgagcccctgccagcctcaccagaagccccagcccactctcctaaggccaaggctgcagatcctcctgatggcttctgttcctcagccagcaccctggaggggctcagcgtctctgatgagacctgcctaagcacctctgagcccagtgcccgtgtaccagattccgtgggtgtgtccccagatgacctggatgacactgggcagccagtccttgagcgaggccagctcaatgggaagcgggacaccctgtggctggcgctgagggagacagtgtatgacccatcattgcccgcttcccatcacagcagcttgtcctggaagggccgaggggggccaggggatggcagccctgtggtgctgcccaatagccagccagacctgccagatgtttggctgcgcaggcccagcactcacacgtcaggctatagcagctgagggggacccggggaggctggacagggcgcggaaccctgtcatggatgacaaggcaagggcagcaataggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgcacattttagtctccttggaatctatctcactacttcactacagggtagcctgacattggtcaggttcttttgacacccaatttataggtaaagacattgagactaagtaagatgaactgacctcagggtcacttagccactaaatggcagagcggtttcattccaccactacaacctccagtttccctttggctacctgccttctttcaccgctagcaccctcctccaatctgctttctctggtgtctctgactgaatccagccaccctctttgggcctccacttcctgagagagctgtattccaaaaaaacccaggagttcctctccatctcccccgtgcctccctctggaatctggctgagatgtctgctggccctggggcgtcctagctgacctgattcccaggcttcaggaccgtgcctcttctacagccacagtgtataagaggccccaccagaagaggtactgaggggcagaagaggtgaagccaaatccaatcaaggcaggaactcagacctgccctttgggaagtgtatgagtctgaagctgcttcccaggttagggtccccagctttttaaggacaagtctctctgtggagcgttaagcagaccaaaggctggttcctccttcccaaacttcctggtagggaagttttatcccatgtgagagctcatgacaccaggtggcatcaacatgtttattgaacacctactttgcatatggtattacaaggggacagaggtgtggaagaaaaattgaacaccaccctcaaagagctcaccttctagctggggagacagcttatgcacacatgcaggcatcggatggctcacggacggcaccatatgcctgccatcatcattattgttggagctcaagtacccaggactgggtaacaagaaaggctttctggaggaggaaaaacttgagctgggcttcagaagaccaagcgtctcagactggaaggggccttggcgatcgtttattccagcagttttcaaattttgtagcctcaggactctttcttcaaagaagctctgtgtggaaaaacaatatataaaacaggtaaaaggcagctactctggtgggcgctgggtgttgggggtggagtcagcttagcctgtctttccactgcagcctctccgggtatctggggaacccctccggctcctggcagcttcacagaatgtaatatgaaagctactgatccaggctattttacagaggagtatcaggaaagggaagggattgttctagggccaaatagtctgtggcagagctggaggcaaatcagatgatgtttttgttttatttagttttttattattgagacctacttcctactccaagtagcccatgagaagtggagcagaaaccgaaaagagacatgggagttgtggaagagacagaaggcaataggcaggtacggcaggataccttggctcctttgcaagataagtaaatcaagatgagtaactcctgacaccaggaaggggaagctggaacctaatttgaacctgtccccagggggtctgctgggacctctctcttcatgtccaggtagcattcggcctctctgacctagagctgctcatcagccctggtttctctgataatggtgtccctctgtcatcatgcagccaggctgagagagccctggtatcctcagggacaatgagccacagggaggttaagggaactcttcctcccaagcatgagcagaagacactttgcctgaacataaccactgaaatgttagaatgcagaggggtggatgggtgggcatgagggatctgagcacacccgagggccctacctggggatttccaggtcatattcttgcaggctgtggccacacaacacttcaggaaggtgaatgagccatagcagctgatgcattgattagatttgttctttatgttgccaggcccagaagaacccagcagtaatctaaaacattaccttatacctagaatggcccaaaccaacagcaggcaatccacatcagcaggaaatccagcctgcctctctagccctgactttggaatgtggaacttaaagcacttcctatttcctttgagttgcagcagatcctttgctttattattattaggggcacttacaatgagtgtatggccctggagacatggcttacaagcacgctgtgaggcgtacaaaaatgagtcaaagcacttatgcttgccctgcaaaattcaagaaatgatttctccccactcagacactctaatagaactacattaacatttggaacttgaggtcatttcccctatttgtgccactgatccttgaactcacattctgagtacgagtatgtatcctgtatgctattaaaatataacttgaggccggacatgatggctcatgcctgtaatcccagcactttgggaggctgaggcaggtggatcactagacgttaggagtttgagaccagcctggccaacatggtgaaaccccgcctctactaaaaatacaaaaattagttgggcgtggtgggggatgcctgtagtcctagctacccaggaggctgaggcaggaaaatcatttgaacccgggatgcagaggttgaagtgagccgagatcgtgccactgcactccagcctggatgacagagcaagacaccgtctcaaaaaataaataaataaataagtcgggcacggtggctcacgcctgtaatcccagcactttgggaggccaaggcaggtggatcatgaggtcaggagatcgaaaccatcctggctaacatggtgaaaccccgtctctactaaaaatacaaaaattagccgggtgtggtggcgggcgcctgtagtcccagctactcgggaggctgaggcaggagaatgatgtgaacccaggaggcagagcttgcagtaagccgagattgcgccactgcactccagcctgggcaacagagcgagactccatcttaaaaaaaaaaaatatatatatatatatatgtaaacttgatatagtctgttaccatgggaaaaccatccttccatggctgtggtgatttggggacttttagagtgacagtgttagacagactgattttattggctgaatcttagattttactgatatatagcatatcccataccatgatatgcgggcaatattccagcttgagacaattttttttttttttttttgagacagagtcttgctctgtcgcccaggctggagtgcagtggcacaatttcggctcactgcactaattttttgtatttttagtagagacagtagagtatttttagtgttagccaggatggtctcgatctcctgacctcatgatccgcctgcctcggcctcccagagtgctgggattacaggcatgagccaccgcgcctggccgagacaatttttaaaaagacatttctcaagagagttataagccaaaatttccctagccccctccaactcattctgtccttctcccagtgcatgtcaggacagggaagaaggctttaaatcagattttaagaaagaggatacattggtttacaacctttgcctatcgtccagagagtttctgatcttttctttttttttgagacggagtcttgctctgtcgcccaggctggagtgtagtggcacgatcttggctcactgcaagctctgcctcccaggttcacgccattctcctgccccagcctcccgagcagttgggactacaggcacctgccaccacgcctggcaaattttttgtatttttagtaaagacggggtttcattgtgttagccaggatggtttcgatctcctgaccttgtgatccgcccacctcggcctcccagagtgctgggattacaggtgtgagccactacacccggccctgatcttttctttgacggtggcagtatctcattttttgataatacacatgggtaatggcaagctcttgggaccccatgccaagcatcaagatcccatttacctggtgataggaaagacagacattcctcaccctttctacccacacccttgttcacagggatgactgtaactaaggtctgcaggtatttatgcttaggagaagaaatcgtagttcaattcaccaggaatatgagaaacaaaagaaagccactatgtgctatgtaaatgtctggccatccaaagccaccttatgcagaggaacactggaagggccttgataaatttctcataattattatcgggcctctttgtgattactcacatttttctcaatataggggaaagatcagcattttaccaaatccacaaccatcaaacaaacaagagctttaatattgctaaagaaaatcacacagctgagcagattgatgtagatttgaattcatgaccacctatcttaactggaccctcagctctgcctagctagtattcattctagctactagttttgattatttgtattgactcttttatattttctccaccttcctcaaatatctcaccttcccccacccctcagtggacaaaaaaaaaaaaaaaattcttcatgaagaaaactgaagccttcaaatagaaatttcctcaccttcaaggcaccaaagccacaacttacctacccccgctcctgcctgctcctctccccatcccttctgctacaacgaaggaagcagtaatggctccatcaatggcttctcacacttggtgtcagaggccttcacacgagggtttgcactcccctacaaggacatgaagactttctagaaggtaggtggacacagatagttttaaagtaatcagtttccagagccgccttctccatatgttcccctccttatattggtgggcctaagaagccacaggcctgacagctgtccttcccaacttccactttcccagttgcctcccctccctcattctgaatcctactctggctccttgctctgcgctgtaaaaaacaaataaaagggccacttgagaatgctctgcttgaggaagtccttgaaagagcaaagcctggagagcttctttgagaaagttcacaggggcagccctgtggctcagttctgtgccttcttcatttaagaattcaaattcattgacatgttatattgtaaaatatataaatatatattaaaaaggaaaaaataataaaaatttttaaaaataattcaacttcaggtgagacacagtggctcatgcctataatcccagtgttttgaaaggctgaagtgggaggatggcttgaggccaggagtttgagaccagcttgggcaacatagcaagatcccgtatctacaaaaaataattttaaaaattagctgggcatgggccgggcgcggtggctcacgcctgtaatcccagcactctgggaggccgaggcaggtagatcatctgaggtcaggagttcaacaccagcctggccaacatggcaaaaccctgtctctactaaaaatacaaaaattagccgggcgtggtggagcatgcctgtagtcccagctactcaggaggctgaggaaggacaatcgcttgaaccctggaggcagaggttgcagtgagccaagatcatgccattgcactccagcctgggtgacagagcgagactacatctcaaaataaataaataaataataaaataaaaataaaaattagctgggcatggtgatatgcgcctgtagacccagctactccagaggctgaagcaagaggatcacttgaactctggagttcgaggttacagtgagccataatcacattatggcactccagcctggcaacagagcgagaccttaactctaaaaaaagaaataaagaagaatttaaactgaaagtgagatggttgacacaggatacatattaaccacattgatttgaatggaaaaataaaatcagactttttctgttagaaggtcagaattggctcacaggtttgacagagaggatagtctttgcaagtaggatgtatggtggacattttccctaaaatggaataactttaatctgcagctccacagtttgaacaaaaacagactgaaggctgggcgtggtggctcatgcctgtaatcccaacactttgggaggcctaggcgggcagatcacgaggtcaggagatcgagaccatcctggctaacatggtgaaacctcatctctactaaaaatacaaaaaaatagctgggcgtggtggcgggcacctgtagtcccagctactcaggaggctgaggcaggcgaatggcgtgaacccgggaggcggagcttgcagtgagccgagattgcgccactgcactccatcctgggcaacagagtctcaaaaaaaaaaaaaaaaatttttgactgaaagtacagatacaacttccctttccagccaagatggaggagcaggggccaagtttatcctcctgcctgaaacaaccaaccaaacagtaaatacatgaaataatgagtttcaagacactggacatgaggtaacaaaagacagtgatctctcagaggcaagaaacaaacaaggagaacccctcggttgcccagcttaccgcttgagaggatgtatttcacggagggagaacccaggcaaagcaagtgactctgaggtgaggggatagctgggagtgtggagcagccaagctggctagagtgctcaggacagggtactggagaggagaaaggtggatatatagagaattctggggatctgcaaagggccccccttgagtgttccacagagcatgattcatcatataagtgtaaggaaaccacttgagacaaaggaaaggaccacccaaaacaatgggccggaacagtagccagaagtcacacacagcctggaccacgcctgtccccatcagccagattggaaaacctcaaatttatggagcattggtcagaggtctcagaagggccttgcctcgtagtggggattcattagccctagtttaaacattgctggaacctacctaacaaatctcaaaagcaagacctgaattcaggaatcaagctgtttctaagtaactgaagtgtatcccagaacaaaacccaagaacattaacagaaatccaaaattaacgagcacccaaaaatgtaaaattcacaatggctggttttccaataaaaaattaccagtcatgcaaactataacccatcataaggagaaaaatcagttgaaaccactacagctgacacctatgtgagaattagacaaggacactaaaagaattattataactgtattccatatgtactaagtagagactaggaagatatttttaaatacccactttgaattttagagacgaaaactaaaatgtctgagatgatggggtgggtggggtaggcagaaagaggaggatgggaagaagtaccaaggggaaggaggaatgatttggggatgacggctgtgtttattatcttaattgtggtgatggtttcacaggtatatgtaatttctaaacttatcaaattgtacacttaaaatatgtggtctatggaatgttaattatatctcaataaagctgttaaaattgtactgaaacaaaaccattgggggaaactgggtaaagagtccaaaggacctccctatactatcattgtaacttcctgtcaattataacgattccaaaataaagaatttaaaagtgt

SEQ ID NO: 5590 - DNA, 335 bp, Homo sapiens
  ENST00000559721
caggaaggggacattgggtgacccaccccaaggcaggtcagaggggcttgccaaggaaggctccctggggagtggtctctggcctcctctgagtcttccaaccctaatggtgcctggcatagatattctctccacttcagctcgagctcccacaacactctgaggcctgcacccagaggcagtgcccaggagagcgctgtccggcctcggagaatggtggagcccctggaggacagaaggcaagagaacttcttctgtggcccccctgagaagagctatgcaaagctggtgttcatgtccacctcctcgggcagcctatggaacctgcatgccat

SEQ ID NO: 5591 - DNA, 519 bp, Homo sapiens
  ENST00000558623
ccaggcaggactcccaaggggaggaggctgagcccctgccagcctcaccagaagccccagcccactctcctaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgca

SEQ ID NO: 5592 - DNA, 401 bp, Homo sapiens
  ENST00000561261
ctcaaagagctcaccttctagctggggagacagcttatgcacacatgcaggcatcggatggctcacggacggcaccatatgcctgccatcatcattattgttggagctcaagtacccaggactgggtaacaagaaaggctttctggaggaggaaaaacttgagctgggcttcagaagaccaagcgtctcagactggaaggggccttggcgatcgtttattccagcagttttcaaattttgtagcctcaggactctttcttcaaagaagctctgtgtggaaaaacaatatataaaacagttttttattattgagacctacttcctactccaagtagcccatgagaagtggagcagaaaccgaaaagagacatgggagttgtggaagagacagaaggcaatag

SEQ ID NO: 5593 - DNA, 910 bp, Homo sapiens
  ENST00000423056
tgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggttccatgtccccgttactctctctttggaaatctgacgaccctccaccgtggcctcagcagcttctgttcccctccccaggaagttttctagggccagatgccacagagccccagtgatctctccaaggggccaagaactttgggtgaagcattctggaacccccctcgagatctggctagccatgagatctggtagccatgacctggcttgccctttgacacctctcctgctgttgtccttcaaatccagaaactgggttgaaagaagagtagtcccagcatggtgtggtggaaggagcactggactggaagtgaggggacctggatcctagtccgagcttaaccacagactcccagtttgcccttgggcaaactacttcccttctctgagcttcaggtttcccgtctgttaaaggactgcctgaggtgacctgtagggtcactttctggccctaataatctggaacattgactctctagtgagtctcttgagtgtgggtgggattgaaaattgtgattctaaccccaaagattaccctacctttccccttccttagagcacccaccactagtgaagtcatcctgttccctgagtgagggatgtttagatgatttccttaataggaccagagatgtcaagtaattttcttgaggtcatactgctgaagtgcaatcttcattggggcaggcattacttctac

SEQ ID NO: 5594 - DNA, 5215 bp, Homo sapiens
  ENST00000294484
gcggctccgagaagcttccccctgcgacttccgcgaggagacgagtctgcgcagcgtggtggccgccgccccccgaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtggcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggggctgttcgtctccatcctcatcttgtccctggtgttcgccagccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggaagctgtacttcgcccagtcccacaagccccccttccacgggcgcgtatgcatggcaccccctggctgcctgcttagctccagccccgatgggcctaccaaaggcttcttcttcgtgcctagtgagaaagtgcccaaggcccgtctctcagccaccttcggcttcaacccctgcgtgaacacgggctgcgggaagccggcggtgcggccactagtggataccggggccatggtctttgtggtcttcggcattattggcgtcaaccgcactcggcaggtggacaaccacgtcattggagacccgggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgcagactgctgctgttaatacgagcattttaagcac

SEQ ID NO: 5595 - DNA, 1495 bp, Homo sapiens
  ENST00000304391
ggctcaccacacggcaaggtgcccgcttccaagctgaccccaccagcactcagacacgcatgcacacacacacgcagacctactatgaactggcttgtgctcagcaagagcagaattgatgagcagataccttaagaatcttttagagcaggaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccc

SEQ ID NO: 5596 - DNA, 1945 bp, Homo sapiens
  ENST00000529225
gttgggggggatctgggtccagggggcgcggtctgggcctgcaggaggcgggatccggcgggccagaggcgggaccaaggccggcaggggctggctctggctggctggagtcgggcggggcttgtggccggcccccgcatcaccatggcagcgggaaaccgcggcaaagccagagcactggcaggccgagctcaggagggctggggacagagatgctgaaccagacggacccatcatttaagagatggccctgattcgtctcttctagggactcttgaagatggggacccaagtggttatgagattcaataactccttgctgccaacagagccttctcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccaggtaactgtggcctctgaaacctgaattctggaggattctcggagttctcggcttcaagtaacaatacaacaagcaaaaaggcacctaagccctttttctcccctcagtttatgtttggctttaaagggataccccttagcagtgctttgtgggtttgtgctagtaggagggtaggaaggtagggtggggtgctggtttatttcccacaaatggaatctgtgcagtcccagtgccagtgcttaactgtgaccacatgggggcatggctggaacctgtcagggcccagtccagtggttctgacatttgcatatgaggtgccagtgtttatgatagccagttccattgtgctgtccttgagcctaagtgtaactcttaaggccggaaaagtctgtgtaaagctcatagaagagaagaaattgagcagagttgtcttagagcattagaatgtttccaactttcctctacaggaactgtggctgattagtatgtgtttgagcaaactaatgatgtttgcgactctagctaaaagttgtgtgtatcctttagagccaagtacagagaccaaaacaggatacagtgccctaataaaaaccttatcagtggcagaaaaaagattactttactggctcatgtaaattgtgcttctataaacactccccagatcatgtttttactaacttcattttgttgctgaatcataatttatgctctaatgaccttttctttcctatcccaaccctgtgtaatctgctctatttagggctaattgttccttgtcttgtatgtatgttatgtgtccttgttttcttcctcctatttttttctcataaaactccatcctattttaatgcacatttcctaatttattgaggtcatatggaactctttctagtattttaatatactggtaaacttgctaactttttaccttttttacatttaatagctgtgctctttcttacttataaaattcacataacataaaattaaccattaaacattataaagtgta

SEQ ID NO: 5597 - DNA, 5897 bp, Homo sapiens
  ENST00000440460
tcccgcaggaaagcggggctgggggcagcccggcagcgccgctcaacctagtgcgcgcccagttgtttccataggaaccgcgaccgcgccgggcccctccagcggaggcccccgtgcgagcatgcccagtgcaagccgctagtttggctccagtctaggtttccagtaagtggcatgcgggactccggagggatcccaatgagctgagccgagagcctttgtgtgcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaatttttacatttttaaatttgaagaatttgttttaaacttacttggtaatggcacttctacttactgaccaacttttcagctctttttgaccaggatggttgcaaattagggaaaatatctttatactatacatccaattcaagaggactttaattacttaaaagcatttaggtcataattaaaattattttcactgtttccataaaataagcattatgattgcacactccttctactgtctgaatttatgtaagaggtatagcttgcttaaaatacatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaactaaa

SEQ ID NO: 5598 - DNA, 741 bp, Homo sapiens
  ENST00000528399
tttgtgtgcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggtaagggtagaaatctgggggtgggaactgatccctctctctgatacttcttctgttagatgatacagtgcagtagatagaaacgtcacccaaacagccccagattgcagaaa

SEQ ID NO: 5599 - DNA, 559 bp, Homo sapiens
  ENST00000614104
gagcgtcagagtctccaccccgaggagcggccagagccccatgcgggcctgacctgtccgaccgacccctcgtccaccaagggagggctcagagtggagaagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaag

SEQ ID NO: 5600 - DNA, 4825 bp, Homo sapiens
  ENST00000615255
atccggaaggtggcacggagtgggatcgccgctggggactcgaggcgcagcctgcgccgccgggagcctccctcccagtgggagatgggttgagatgcccccgccaggggggatgcccggcaccgtgcgtccgcggaggccaagatgcagcggccaggggccggcagcctgcgaggggaggcagcttccgccggggccgggctgctgcacagtctgagcggccgggactgcgcgcttcagagcctggagcatcccagtcgctggggccgagacgccgccgccgccgccgttcccgctttctcccgcgagccgggccagtagctttgctagctggccttcccgtggaggcgttttccagccccagcgcggggagacatgcctgaatttgggagcgatgtgactctcagcctcccacttcacccggggacgcaggcttgctgaagcccgagacaggagggggaccatgggagggacgcaagtcaaatgcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctcc

SEQ ID NO: 5601 - DNA, 3424 bp, Homo sapiens
  ENST00000618522
gtgctatgagaacaggttcagaacgcaggtgacctgaacctgtgaacgctaccctgtgaacgctgtctgctggaaatcagttttcttcaacatgaactgtactccctcttttcattttttagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttg

SEQ ID NO: 5602 - DNA, 1350 bp, Homo sapiens
  ENST00000526500
aatgcattctgaagcaacccagatgtcaccatctgatctaactatatttggtttgcagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcc

SEQ ID NO: 5603 - DNA, 509 bp, Homo sapiens
  ENST00000530645
aggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaagtaagtacccatttttgctcagtagggactcctagcatattagaccagaaatttagtatttttcacactacattttggggatgtaatttttcttgtagtacttcacttttatactattttgtttctgtagcaatactgcaattgagttagttctaagactatgaagacatatgccatca

SEQ ID NO: 5604 - DNA, 578 bp, Homo sapiens
  ENST00000526418
atatttaatactgttttcattccctagtgatgactggttctccagcctctgctgttttagtcatctgggttatcggggcagtgacctaacaaggggctatttctgcttattgactttggcagggggctgtgtttaaagttaacatcttatctttccagctattgatcaacagtctattttagtgctctctccttgtgttgcaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaat

SEQ ID NO: 5605 - DNA, 894 bp, Homo sapiens
  ENST00000220812
gtcagactttgctcagccgatttcacgcaccttactcagactaaggtttacttctttcagaaaaagcagtgacaaacagacgacgtgctgagctgccagcttagtggaagctctgctctgggtggagagcagcctcgctttggtgacgcacagtgctgggaccctccaggagccccgggattgaaggatggtggcggccgtcctgctggggctgagctggctctgctctcccctgggagctctggtcctggacttcaacaacatcaggagctctgctgacctgcatggggcccggaagggctcacagtgcctgtctgacacggactgcaataccagaaagttctgcctccagccccgcgatgagaagccgttctgtgctacatgtcgtgggttgcggaggaggtgccagcgagatgccatgtgctgccctgggacactctgtgtgaacgatgtttgtactacgatggaagatgcaaccccaatattagaaaggcagcttgatgagcaagatggcacacatgcagaaggaacaactgggcacccagtccaggaaaaccaacccaaaaggaagccaagtattaagaaatcacaaggcaggaagggacaagagggagaaagttgtctgagaacttttgactgtggccctggactttgctgtgctcgtcatttttggacgaaaatttgtaagccagtccttttggagggacaggtctgctccagaagagggcataaagacactgctcaagctccagaaatcttccagcgttgcgactgtggccctggactactgtgtcgaagccaattgaccagcaatcggcagcatgctcgattaagagtatgccaaaaaatagaaaagctataaatatttcaaaataaagaagaatccacattgca

SEQ ID NO: 5606 - DNA, 7447 bp, Homo sapiens
  ENST00000276297
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 5607 - DNA, 4392 bp, Homo sapiens
  ENST00000358919
gaggctgcggccacgaggaagaggggcggggggcggagcctgggaatggggcggggccggagaacagcccgtcgctaaggcctgcgacccagacagcggggaggaggcggtgccgcccgctctggccccgcccctcggggggtgggcccagcgggagggcccggctggcggagcgcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacaccctt

SEQ ID NO: 5608 - DNA, 2028 bp, Homo sapiens
  ENST00000510318
gctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttgaccctaaatgctttcgatctcatcaagaactcagaagtgattcttacccttttttcaagacaaaagggaccttgtttttcacactctatcagatgcacctaattaggggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaa

SEQ ID NO: 5609 - DNA, 3758 bp, Homo sapiens
  ENST00000512044
agttggcgcttcccggggccgcagtgccagccgcaatgccggcctcctgaaggcaggcgacagcctgcggccgggagcacagcgcggggcggagtaccgaggcatggtcgcggcgcccgggctgcgctgaaggcgtctgcgagcggatgggggaccccaaggcccacgtgatggcgcgccccctgcgagcccctctccggaggtcctttagcgatcacatcagggactccacggccagagccctggatgtcatttggaaaaacactagagacagacggctggcagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaa

SEQ ID NO: 5610 - DNA, 3556 bp, Homo sapiens
  ENST00000520226
actgacttcgtgccctccatgttccttgacagcctgggcctctcctactggattaatacctgatgagtacctgatcacgcaacagtgaaacaacacaagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgc

SEQ ID NO: 5611 - DNA, 485 bp, Homo sapiens
  ENST00000521730
ttgccttggcactgaaaaatacatcctctttccaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggtatgttctgattctgatttttttatatggtgagggtcatgaaggaaattctgacttt

SEQ ID NO: 5612 - DNA, 920 bp, Homo sapiens
  ENST00000513883
atttctgcttgacagcctgaaatgcatgacatgggtttcctgctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttgaccctaaatgctttcgatctcatcaagaactcagaagtgattcttacccttttttcaagacaaaagggaccttgtttttcacactctatcagatgcacctaattagggtattacatgttgttttctgcttgttccttcctataccgccattctgtaaggaaatccatcagcttccttaagactgtagaccccaattctccaggttcaaggtggaaggacgctcctaactgaggaaacggacctgtcaacccccactcttagaagatctagaacagcactgtccaggagaactgtctggatgataggaatgttctttatctgcacaggccaatacagtagggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtatttt

SEQ ID NO: 5613 - DNA, 1925 bp, Homo sapiens
  ENST00000510250
actttaaaattaaaatcatgaagtacaagggggaaattgatactactggcatattatgagcagcctcctgctcatgccctgctccctgctggctgccagccccagtgtgtgaatggctcctttctgtctttgcagagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaa

SEQ ID NO: 5614 - DNA, 455 bp, Homo sapiens
  ENST00000509922
gcgtttccctttgaaaacgcgaggtcacctggactgcccctgaagggaagacctgctatgtgacccaggagcagcccggcgcggacccagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcagagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtctt

SEQ ID NO: 5615 - DNA, 562 bp, Homo sapiens
  ENST00000503161
cgttcttgagaatcaaccttgaaagttaaagacaaggccacctgccagccccaccctcccacctcccctgcgtgcttgcctgcggcgctgcgtttccctttgaaaacgcgaggtcacctggactgcccctgaagggaagacctgctatgtgacccaggagcagcccggcgcggacccagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagc

SEQ ID NO: 5616 - DNA, 582 bp, Homo sapiens
  ENST00000515225
agttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcagagtgacgattcagacgaggatgagccttgtgccatcagtggcaaatggactttccaaagggacagcaagaggtggtcccggc

SEQ ID NO: 5617 - DNA, 560 bp, Homo sapiens
  ENST00000506171
agagccctggatgtcatttggaaaaacactagagacagacggctggcagcagcggtaaaatcagtaaagttggaagtggatgaagataagagcacaaagggatccaatttttccaactcggaagtggcaattggtttgtctccttacacctttccccagaagaggcttttccatgttgctggagaagaaaacatcacctaggccggtgtgtgcctggcagaacactgcactccaatttcctcgggcagccacaaaaaaaaaaaaaaaaaggtggggttggggccgggggacagctcttcagtaagatgtgacaatatgccagtttcaccaatgataagagaaacctgagataccaacagtcagcacagaccacaggtcatgtttgacagtgcaaagctgcaaggtccttcagaccaagcaaataggagagtgggctccaaagcctgtcaacagggtcccgaaagctaaaagggaaactttcctaaagaacccgggaaacaatgtaaggatgctaaattggtcatttacggatgccctccctggttagaagaaacttcctt

SEQ ID NO: 5618 - DNA, 1837 bp, Homo sapiens
  ENST00000316609
ttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgcggtaaaatcagtaaagttggaagtggatgaagataagagcacaaagggatccaatttttccaactcggaagtggcaattggtttgtctccttacacctttccccagaagaggcttttccatgttgctggagaagaaaacatcacctaggccggtgtgtgcctggcagaacactgcactccaatttcctcgggcagccac

SEQ ID NO: 5619 - DNA, 2451 bp, Homo sapiens
  ENST00000511869
tgggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctggtaagttgacattttggttctgttttctcgccaatctattttagaataaatttcaccttaaaataggcattttattaaatatataaaatgtatacatctcatgaatatatgggaaaatgttgtttaaattctgtaaaagaaatttgttttgctcaatatgtaagaaaaatatacgtggttttctgacataatgacattgtgttagaataagatatgtgtttcttggggtcttccttgtaactgcaaccacaatttttttttcttaagcaaaagaattaaatgttgatcaaggttctggggaatgaatttggaaattagttattaataattaccaaggtttatttttactcttaatgacttagtagccacagaaaaagatgtaattgatgcttaaagctgatgccatactatcaaaaatatagtgatgaagcaatgtgaataattgtattgaagaaaaaaattatagtatttttctgtgttctgtgctttaattataattatttaacagtattatgggaaatggacaaggactgatgagaaatgaaaatatgaaaaattagacatggattggtagatctatgtgtttttaaaaaatcatactatcttatgtgttctgtgtaataaaaacgaaaacagattaaaggtatattatctaacttgaagtacatcacttagtttgtagacatttgtga

SEQ ID NO: 5620 - DNA, 383 bp, Homo sapiens
  ENST00000517868
ccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggtaagacatatgcacagattctctggcttttgaaattttgtaaatatccttggatttatcagttatcattttgcttggattaaaaagatatgaagatggttcttttgccctgttatgcagatgtgtaattcaacgactacccacttggtcaaaccatcaaaatatgtaaaaattaaagaataataatcta

SEQ ID NO: 5621 - DNA, 562 bp, Homo sapiens
  ENST00000631382
atcagacaacacattggcagtgagttcatctgctctactctgctttggaataacacatgtgattaaccaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacag

SEQ ID NO: 5622 - DNA, 575 bp, Homo sapiens
  ENST00000517333
agatgatagttcacaaaatttgtgacggacgaaggatgcagataccatgagcggctttagagatgtgattcaggaacgctgccatgctagatggaagcagttgtaagtgtttaatgtcagcaagactctaatacgatcaagatggagcctgtcttctgctccagcactggatttttgtaactggaggattctgactagaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaagg

SEQ ID NO: 5623 - DNA, 1806 bp, Homo sapiens
  ENST00000529018
gattatcagacaacacattggcagtgagttcatctgctctactctgctttggaataacacatgtgattaaccagataggcattttccaaaaacaaactatgtcactgaagaatgcaagactgtttctttagagccttccatgcttaacttgaaagctgtcaacccaggaggctgaaacagagctagattatgaatcctgagtgaatagctcattctttgcgcccatgcttttgctgcatgctgccatgtggtacaaggctgagaggtatgcactatgatagctaatgaagcacttcctttatatcgcactgaccagaactcttacttgaagcccgtatattatgccactgaaatctcacaatgtgagcttttgttctggctagcagaggcagttgcttgtcctttctgtagctaaatttcatgcaccaaagttgttagaccctttactaatatgtgtaggtctaagtcataaaaccagcttctgctatgtttgcaagaatgttttgttttgttttgtctgccttttcaatgcagcatcccctaaagccaatcatttgtaattttgaggccattgagagataaaaggcttgaagtaaaagtcatcggccctcctgaactcactcatctatgtcaaatatagtgatacagttaacattctaagaacagagattgagaagaaacttaatttaggatgaaaagaatggcatcagatggaccaaaattaattacactgtgtaatcctcgatgtaactgagaaatattcaatgtgacccatttgttatatttaaacatattattatcataaggtattatgtaattagggcctcctttcctggactgtggttagattttgtgtctcattgcatgctttcagaaagtgacctaaagaacaatacatagtgattgtcataacaatctatgaaatataggcttcggttaaccaaaatgcaaatatcaaatatttaaaagttcctcaaaacttataaatttttaaatgaaaaaattatgaaccacattctcaaacttgaggtgtatcaagtccttcagggagtcctccatggttccttcctctccctcattgaacacatcccatcagtcacaaaataccataactacacatccccaaactggcggcttctcttcaatcccttctccaagcccttggtatcagtagccaccatttttcactgtgtgaaagctgattttacaaattgggtcattcttgtaatattcaggtaaaacagaatagaagaaccagggagaaagcactcaagacatatagcacctgctccaagaattaaatcttccacaagcccagctgctgaaactgcccattggaacatgaaaccagtttttctctcatagctactgaaacaacctgctatgagtctaaggccagttttaaccaccactgtcactcatgaatcagagcttgccagctccccagaattttactagtgccaatgaactttctggaaaaacaatatgtaacatttttccttttagaaaacctccaaccttctccttgttctttagacaaagatcatctggtttgtgtgtatgccccgagttgcaattcttgcttcccaaataaaatttagagatttgtctctagattgcatttaacttagacacctggatctaacacacctattattttagcttgttttcagactgctataaagagatacccaagactgggtaattttaaaggaaagaagtttaattgactcacagttccacctggctggggaggcctcaggaaacttataatcatggcagaaggtgaaggggtaacaggcacct

SEQ ID NO: 5624 - DNA, 5034 bp, Homo sapiens
  ENST00000346964
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 5625 - DNA, 4046 bp, Homo sapiens
  ENST00000469371
aataaatagcgaggtaaataatgtatcaatctaatagaatattatacaccaattttaaattattgctgtcaagcccatgtggtgacatggaaagaaatattttaatatgagcttttaaaaaacctaccatttggccaggtgcggtggctcacacctgtaatcccagcactttgggaggccaaggcagacagatcacgtgagctcagaggttcaatatcagcctggccaacatggtgaaaccagtctctactaaaaatagaaaaattagttgggcatggtgctatatacctgcagtgccaggtagtcaggtgtctgagacacaagaatagaatcgcttaaacctaggaggcagaggttgcagtgagctgagatcgtgccactgcactccagcctgggcaacaaagggagactatctcaaaaaaaaaaaaaaaaaaaaaatgaaatttccagctgggtgtggtgattcacacctgtaatcccagcactttgggaagctgagatgggaggatcccttgaggccaggagtttgagaccagtgtgggcaacatagttgagacttgtctcttttattaaaaaaaaaaaacaaaattttagcagggcatggtggtacatacctgtagtcccagccactctgggctaagatgggaggatcacagaagcccaggagaggagggcgaggctgcagtgagctatagtcataccacctcactcccacctgagcaacagagtgaggccctgtccctttaattaaaaaaaaaaaaaaaagttaaaataaaaattcagatttccctgtctcattgaaagttttatttttattttttaaaaataaaagtattagtctttgtttaattgaagggagatatttattgagagaaaacttgagatgacatttacatggatgagaagagtgcctatggttttaccaaacaataaagtcgtgaaatggagtcacttttaaggagggccaggcagtttctggctgggtgtgtttgttctcattgtcttttttatgttttgcaaaagccagccagtgccagtcttatcaaagcagagtttctaagaaatattagttggttttaaaatgcaattgccaccatcggtgccttcccttccagctgagacatctgaatttatgacttctaatattagttggttttaaaatgcaattgccaccatcagtgccttcccttccagctgagacatctgaatttatgacctttacaatcctttatctatatgatctcagaaacatggattttcatcttcagaaacaggagcaaagctggattgaaaataagatcatctatttatttttaattacaaagacatcccgtcattaaaatgggcatctatttgtttaaatatagtttgtcccctttgccagttaacgctgtttcaaaaactgaaatagtgccaacagtattttctcctttgagttttatgtctacatttggactaattcagggtcacttagccctttttgtcatattctacttgctatttataatagatttgttcataaactgtgttgtacaaaaataaggcattgtccttaattacaggagttttcctttgctaatatatatttattatttgaaaaacttaaacgtttcaaagaaaaagaaaatgcttttaaaaaattattttgttatatatggcttatatctcaacatttcattttgattatttgctttttaaactcatgacactgttttattttttttcattgtcctgcaatttcagagcatgtaacttctaatgccagcgatagtgaaagtagttacctaatcttgattacagatgagtatggctgctcaaaaggtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctc

SEQ ID NO: 5626 - DNA, 3994 bp, Homo sapiens
  ENST00000419354
agttctgtcactcactcggggtaactttgggcaaattctctctggacctcctaatagggaggtcctcgtcaccccgaggaagttcgaagacgtgggcagtgacttggaaagcttcccgagattccccttctataacctgggtggctcagaccgggagcggggtcccagccggccggtaattccgcccggaggtgcgcacgaaacaaacctgcagcgctggccgagggcggctcagcttcggagggcgcgactccgggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaa

SEQ ID NO: 5627 - DNA, 3053 bp, Homo sapiens
  ENST00000452595
atcagctaacaaaagaacagcttttggttcctgcagacgctggtgaaaaaataatcatgagaaagaaatccaccttatgtcgtcttttttgtctgcaaaaataaactcagccatcatacagctaacaggtacagagggaagatacgagctctttcataggaagaaatcactgagaaaatgagcatcatttctcaaggtttttattttcactgatctacaagtgatgctgctgtaattgtagctgcagtttttaccgatcattcaccactcagcagctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaa

SEQ ID NO: 5628 - DNA, 2854 bp, Homo sapiens
  ENST00000422288
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaa

SEQ ID NO: 5629 - DNA, 2977 bp, Homo sapiens
  ENST00000448528
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctgga

SEQ ID NO: 5630 - DNA, 2516 bp, Homo sapiens
  ENST00000443183
agctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttacctaatcttgattacagatgagtatggctgctcaaaaggtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctt

SEQ ID NO: 5631 - DNA, 2682 bp, Homo sapiens
  ENST00000450955
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatga

SEQ ID NO: 5632 - DNA, 2690 bp, Homo sapiens
  ENST00000392382
ggcggaaagtttcgggggagagcggttgggggcgcggaaggaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatga

SEQ ID NO: 5633 - DNA, 864 bp, Homo sapiens
  ENST00000475394
ggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcgtaagtaaaccaaacaaaaacatttaattgttactcttaacatttcctgtcactgtgtgtgggaaaaatagatataaccattttttaatggtttgtacttattttatcagttactcttccatcctccatattattgtcctttctcagatttaaattaatctgttctgttgaactttacaaaacgatgtaagtagaaaatggatttattgtggttttttttttaatattaaacactttcccaagtttttttctgttaaagatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacag

SEQ ID NO: 5634 - DNA, 416 bp, Homo sapiens
  ENST00000470629
aactgtgttgtacaaaaataaggcattgtccttaattacaggagttttcctttgctaatatatatttattatttgaaaaacttaaacgtttcaaagaaaaagaaaatgcttttaaaaaattattttgttatatatggcttatatctcaacatttcattttgattatttgctttttaaactcatgacactgttttattttttttcattgtcctgcaatttcagagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcct

SEQ ID NO: 5635 - DNA, 1771 bp, Homo sapiens
  ENST00000419227
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagcagtcattcaatgacaagcgtaaaaagaacctcttttcccgaaaattccccttctacaagaacaaggaccagagtgagcaggaaacaagtgatgctgaccgagatccctgacgacatgggatcaaaaggcctgaagcatgtaacttctaatgccagcgatagtgaaagtagttaccgt

SEQ ID NO: 5636 - DNA, 2833 bp, Homo sapiens
  ENST00000392381
ggcggaaagtttcgggggagagcggttgggggcgcggaaggaggcgaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcgccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcaggtatgcctgtttcttaccacttgaatgtgaggcaacataaataattgatgttcttttaaattttttttaatttgtgacaacatggatggacctggagtgcattattctaattgaaaaaagccagacacagaaagacaaaaatcgtatgatcacatttttatgtgaaatctaaagtagtcgaagtcatacagagaagaatggtggttaccaggggttaggaggatggggaaatgagatacaaagtttccgtgacacaagatgagtgagttctgcacctccaacatagttgagaagaaagaacgagcccgattaaaaacagtgaaattcaattctaaaacgagagataaagggttcctcagagccttcaaactttaagattgaaatcaagacagtctgcttggctaatgaactgtgaacttatt

SEQ ID NO: 5637 - DNA, 2605 bp, Homo sapiens
  ENST00000471733
ttttccccggtggggatctacccccggggtcgccaggcgctgtctctgccgcggagttggaaacggcactgctgagtgaggttgaggggtgtctcggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggtgagtatttgaaatctctacatttttgtaattcctgtttgagctacattgttaaaatgaaaaggattttgctatcagaattattcatgatcagttcttgccatggtgctttacaatggtagatacttaagcatttgttaaattcaagcacccatttcacagacccttccaaattatcaaaactatcatttgatatattattagcaacatacttttgggtcaagcttatttttataaatgaaatgtatttgaccttcattcgatttccaattagaaatttgtgttactaggccgggcatggtggctcacgcctgtaatcccagcactttgggaggccaagtcaggcagatcacctgaggttaggagttagagaccggcctggccaacatggcgaaaccccgtctctaccaaaaatataaaagttagccaggcatggtggcgggcatttgtaatcccagctactcgggaggctgaggcacaagaatcacttgaacctggtaggcggaggttgcattgagcccagatcgcacctctgtgctccagactgggcaacagagcgagacccaatctctt

SEQ ID NO: 5638 - DNA, 207 bp, Homo sapiens
  ENST00000493937
atgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggtgagtatttgaaatctctacatttttgtaattcctgtttgagctacattgttaaaatgaa

SEQ ID NO: 5639 - DNA, 858 bp, Homo sapiens
  ENST00000447466
tttttcactcgaagacacagctttattgactgcatctcggtagccaccagctccacccaggcaaatcctcccccagtactggtcaacacagatagcttggaaacaccaacttacggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggt

SEQ ID NO: 5640 - DNA, 732 bp, Homo sapiens
  ENST00000477312
gtttctgagctgcttttcttttcccctgtaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtaagtataagaaatctattgtcttttaaatcattttgtagtctgtttatttttctgatagatactggaatttctccataccaaaaaggtctaaatgatgtttaaattagcaaatactagccttgctgtatcaaatcctaaaaaatgattcttggtaattctttatttgtcatttctcttttctctgctagctcctcctcccttttccttttattcct

SEQ ID NO: 5641 - DNA, 539 bp, Homo sapiens
  ENST00000453607
gtagaaaaattgctacctctaagaatggatcctggagagatctagttacagttataacttcttcatttatggttttatctcacagctttatttatttttatttacatgttttgttcaactaggcaacttaaaatagttttgctttatgtataaaatattgtaatggtagagtaatggattgcctgtgcattgtaaccacaaagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaaga

SEQ ID NO: 5642 - DNA, 629 bp, Homo sapiens
  ENST00000456699
gcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttac

SEQ ID NO: 5643 - DNA, 716 bp, Homo sapiens
  ENST00000392380
gcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaa

SEQ ID NO: 5644 - DNA, 656 bp, Homo sapiens
  ENST00000485409
actattctgtaagcaactgtgggatactaagaatttgtattttgaaatgttaaaaatttggattatgatgacaaattgtagataatctgcttttgcattatcagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggtaggatagtatctatttattattgttatgaattacatattacttttgttatacatatagctcatgctcggagagaagtattctttca

SEQ ID NO: 5645 - DNA, 582 bp, Homo sapiens
  ENST00000419553
ggtggggatctacccccggggtcgccaggcgctgtctctgccgcggagttggaaacggcactgctgagtgaggttgaggggtgtctcggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcatt

SEQ ID NO: 5646 - DNA, 558 bp, Homo sapiens
  ENST00000469073
gtatcttattctcatggaggagatagcagagcttgtactgcagcaagtggagctctgtggtgaatccgatgctggattacattttaaggatattagcaaggccctgacaaagtggtgctaaatgagcactttcattctggtaatttgactataattttagtgaagcagttttattatgcaggaaaaagaaacagcattttaattccaatcatagtataccgacctgatctctgctgtgggggtggaaacaatgaagaatgcaacattttaatacaattttttttaaaaagaatgctttggatctagattaaatgttcaagacagtcagcaaacaacatgcacaaaggcatttttctggaatttcagtcttggatcgatttaaatgctcagggtctgaaaaaatgtctcctagcatcaaaaacttggattgcttttctccgatgttatgccactgtaaagtagcatgctccaacagcacaatatccttaatgtttggatgtaagaaatacaggtatcaggatgaagatacacctcctcaagagcatatttccccacaaa

SEQ ID NO: 5647 - DNA, 543 bp, Homo sapiens
  ENST00000436682
agcaaggagaaaggcaagcgagaggagggggcccgagcagggcgggcggccagtcccgctggtcccctctcagcgctctgcggccgctgctggctcaggggccaagggtcggagcgcttcacccgcccgtacccagtagcaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccac

SEQ ID NO: 5648 - DNA, 479 bp, Homo sapiens
  ENST00000486877
gcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagaggtgagataaaaaatgtgttctgaagctgttttttggtgatcaatttatttatgttactatgtttcttta

SEQ ID NO: 5649 - DNA, 710 bp, Homo sapiens
  ENST00000412364
ctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagag

SEQ ID NO: 5650 - DNA, 309 bp, Homo sapiens
  ENST00000434148
tgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtgtgtgccctcttcctgattctggagaaaaatgccggtccggaagcaagatacccagagagcattgcaccttttggaggaatatcgttcaaaactaagccaaactgaagacagacagctcagaagttccatagaacg

SEQ ID NO: 5651 - DNA, 4931 bp, Homo sapiens
  ENST00000357674
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgg

SEQ ID NO: 5652 - DNA, 1894 bp, Homo sapiens
  ENST00000489885
gtccctgccctctcccgtgctctccatcttccctttcctttccctctgtcttttactctgtccatacccgcttcctgcctgactctctgcccccgtgtttcttgacatccatgtcactccccttcggccaacttcccattccccacctctccccgtccgtgtccctccggcactgctctctgtcctttctcgccacccgctggcccccctccgcccaccctgcctgcccccaggggaagcactgcatcctcgatgtctcggccaatgccgtgcggcggctgcaggcggcccacctgcaccccatcgccatcttcatccgcccccgctccctggagaatgtgctgtgagtatggtcctgggggcctcccctttgctcccccaacacctgtggccctgggcctcacaaggcgtctgcgttcaactctcccttcagaaccctggacagcggtttcagcagcccctgagggggatccctggaacccagaggatgtgggggaatcgggtctttcccctcctctcctgccttggctagacaggactacatttcccagcagcccctggggcataccagctggggcgagtcagggcctctagggctgttgggaattggagtccgaatcccatctctggggctgaaggctggaaggatgaagctccgtagatgtccctggagtagccacacctggctggggcggttgcgggtggcaggggggtggggggtggttctcatctgtggccccagaggatattgggaattgtatttttttttttgctatgtgctccaaatagaagaatacttaacattcctggatagaggagataaaaggcagggtcaggtgggtccagtctcaggcctgctctccctccctcttcacagagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 5653 - DNA, 3185 bp, Homo sapiens
  ENST00000399506
cccctccctcccacgctcccctccccttcccttctccaaccccctccttcccctctcacccctccccccatcctggccccccctgcaaaagtggggtgcggaggggggaggggtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 5654 - DNA, 3184 bp, Homo sapiens
  ENST00000302955
gcccccttcccctccctcccacgctcccctccccttcccttctccaaccccctccttcccctctcacccctccccccatcctggccccccctgcaaaagtggggtgcggaggggggaggggtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 5655 - DNA, 3975 bp, Homo sapiens
  ENST00000399510
gggacagaagaggaaggggcttaagtcactgcagccagagggatggaggtggactgaagggagggcttctccggtggggttagaagggaaaagtagggaaagagaagtgtaaggtagatggcagaggcagagacatggaaagacagactctagggttcctgatgaaatctatctcggccaacacaaaagggagggtacagtggtggggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagaccatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagcgtggctaggttctgcctgcctatgggaagagggggccagggtgtgtggagcaagatggtggcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 5656 - DNA, 869 bp, Homo sapiens
  ENST00000491753
ttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcagagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcaggg

SEQ ID NO: 5657 - DNA, 1004 bp, Homo sapiens
  ENST00000485100
gtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctgtgagagcccttcaaacaccaaagttccccatgacccatcccgtttaacccatgacatgcagtcccacgacatccctgtagctgtccctcttcagatattccctatgaaatagccacaacctctgatccttgctgttgttggagaagagatggaaaatcaattaccataaaagaactagaaaaga

SEQ ID NO: 5658 - DNA, 926 bp, Homo sapiens
  ENST00000451807
cttggatcctctggtgatccaagccttcctaccagatatgaaactaggacattgggggtcatcttgggggcgcatgtaacagatgccgatcaacggggtcaatctcgcttggaaataccgctaccaagatgaagacacgccccctctggagcacagcccggcccacctccccaaccaggtaaacgcccccgagctggtgcacgtggcggagaggaacttgtcccacctcgaggctggccacggggtcgtgggccacgcccacctctcccccttcaaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatg

SEQ ID NO: 5659 - DNA, 763 bp, Homo sapiens
  ENST00000447163
gaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggtaaacgcccccgagctggtgcacgtggcggagaggaacttgtcccacctcgaggctggccacggggtcgtgggccacgcccacctctcccccttcaaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggag

SEQ ID NO: 5660 - DNA, 586 bp, Homo sapiens
  ENST00000486626
gtggattgaggctgggcccttgagcagctctcagggtggcggagtgggcttggctaagaggctgaaagggtagccacgctgatgggaccctccgttatgggctccctctcgagtcaaggctcaggctgctttttgtctcttgttttcccaaacaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagg

SEQ ID NO: 5661 - DNA, 573 bp, Homo sapiens
  ENST00000493294
actgcgtagggtgaggggcgtaggggagcgaggaaggcaggttattcaggatgcgctgcgcccacaaacctcttcagcccggcctcctctcggcctggctaacgtggggcggggcccagggcaggagaggcggggctagcggatcccttctgcgctcaggagtttggtcggccccaggccacgccccacccccctgttgtcctgacgacagggcctcctggaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaa

SEQ ID NO: 5662 - DNA, 10130 bp, Homo sapiens
  ENST00000620101
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctacaagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagtt

SEQ ID NO: 5663 - DNA, 3515 bp, Homo sapiens
  ENST00000633183
cgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctacaagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtc

SEQ ID NO: 5664 - DNA, 456 bp, Homo sapiens
  ENST00000632909
tactctccagggctgtcacgtggaaacccctttatcgatgagccctcctcacatctccacccgcgggctctctgaccatgtgtccatgtcgcactcaacacccttgataaatcagcgctgtgaaacactgccaggaaaggcatcatcagaagcaagtgtttaaacggacctcatccctgccaagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtg

SEQ ID NO: 5665 - DNA, 632 bp, Homo sapiens
  ENST00000633560
aaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaagtaagagctcaggcttccctagggcctcttaaatatcatttctcagtaatgcaaatatgcacatcacagcattagtggagaaaagttcctccctttggtattcaagtgaatgaaaataaatgtgctttctagta

SEQ ID NO: 5666 - DNA, 709 bp, Homo sapiens
  ENST00000632284
cggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaaaattgttaccagctcatgctttacaaaaaaatgccttggcattatgccaaagagaagtcgatggaggtgacattggacgccgaatgttggggagatgctgccttccacgtgacccacagtccccgcagcacggctgcatggggctggtgcaagtcagcacagccgtgttccgatcgttcacatggcgtttgcatttctcatggctggctggtaaatcagatccaaggaagagcagcctgtcttgaagtggatttgtgaacggcacaaggccccggtgttaagatgcccgacagacaaccttccatccttcttttcaagacagaaacaatgccaaagtgttatccgagttacttgcttttattaaaagttatgctttttt

SEQ ID NO: 5667 - DNA, 621 bp, Homo sapiens
  ENST00000633014
agcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaaaattgttaccagctcatgctttacaaaaaaatgccttggcattatgccaaagagaagtcgatggaggtgacattggacgccgaatgttggggagatgctgccttccacgtgacccacagtccccgcagcacggctgcatggggctggtgcaagtcagcacagccgtgttccgatcgttcacatggcgtttgcatttctcatggttagggtacatttaacagagtaacttcacaattttgatatctaaaaatcactcattttctgcagcatcttccacccttgttagtatatgcctcaacttggccaaattgtcttaattataaaagggatttataatctttagcacaaagataaaacacaga

SEQ ID NO: 5668 - DNA, 10088 bp, Homo sapiens
  ENST00000620226
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctacaagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagtt

SEQ ID NO: 5669 - DNA, 2263 bp, Homo sapiens
  ENST00000633645
ccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccatggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtc

SEQ ID NO: 5670 - DNA, 8796 bp, Homo sapiens
  ENST00000633447
ccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccatggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcaccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccactgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttctctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttaa

SEQ ID NO: 5671 - DNA, 456 bp, Homo sapiens
  ENST00000631606
tactctccagggctgtcacgtggaaacccctttatcgatgagccctcctcacatctccacccgcgggctctctgaccatgtgtccatgtcgcactcaacacccttgataaatcagcgctgtgaaacactgccaggaaaggcgtcatcagaagcaagtgtttaaacggacctcatccctgccaagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccatggccccaggacagccgcggcctctacaactccacggacagcctggacagcaacaaggccatgaacctcgcgctggaaacggccgctgcccagcgccacctgccagagagccagagcagctctgtg

SEQ ID NO: 5672 - DNA, 632 bp, Homo sapiens
  ENST00000633079
aaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaagtaagagctcaggcttccctagggcctcttaaatatcatttctcagtaatgcaaatatgcacatcacagcattagtggagaaaagttcctccctttggtattcaagtgaagggaaataaatgtgctttctagta

SEQ ID NO: 5673 - DNA, 709 bp, Homo sapiens
  ENST00000631949
cggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaaaattgttaccagctcatgctttacaagaaaatgccttggcattatgccaaagagaagtcgatggaggtgacgatggacgccgaatgttggggagatgctgccttccacgtgacccacagtccccgcagcacggctgcatggggctggtgcaagtcagcacagccgtgttccgatcgttcacacggcgtttgcatttctcatggctggctggtaaatcagatccaaggaagagcagcctgtcttgaagtggatttgtgaacggcacaaggccccggtgttaagatgcccgacagacaaccttccatccttcttttcaagacagaaacaatgccaaagtgttatccgagttacttgcttttattaaaagttatgctttttt

SEQ ID NO: 5674 - DNA, 615 bp, Homo sapiens
  ENST00000632589
agcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaaaattgttaccagctcatgctttacaagaaaatgccttggcattatgccaaagagaagtcgatggaggtgacgatggacgccgaatgttggggagatgctgccttccacgtgacccacagtccccgcagcacggctgcatggggctggtgcaagtcagcacagccgtgttccgatcgttcacacggcgtttgcatttctcatggttagggtacatttaacagagtaacttcacaattttgatatctaaaaatcactcattttctgcagcatcttccacccttgttagtatatgcctcaacttggccaaattgtcttaattataaaagggatttataatctttagcacaaagataaaa

SEQ ID NO: 5675 - DNA, 1336 bp, Homo sapiens
  ENST00000633655
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagac

SEQ ID NO: 5676 - DNA, 1252 bp, Homo sapiens
  ENST00000633162
cgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagac

SEQ ID NO: 5677 - DNA, 277 bp, Homo sapiens
  ENST00000632928
agcgcggtctgagcgcgcggcgcctgcggcggcgaacggacggacggaccgcggacggacgtactgaccccaacccgcgagccccgggagccgtcggtctgaggaggggccgcttcgccatgtcgccccgcacctgctgagcccggagcgtccgaggatgtccgcgctgaggaaggctttctcgccatccgaggcttggccctagccctgcgcggcttccctcgcggctgcgaaccctctgcctgcgcccagcccagccacaatggggactgctcag

SEQ ID NO: 5678 - DNA, 965 bp, Homo sapiens
  ENST00000633950
cgcgcggcgcctgcggcggcgaacggacggacggaccgcggacggacgtactgaccccaacccgcgagccccgggagccgtcggtctgaggaggggccgcttcgccatgtcgccccgcacctgctgagcccggagcgtccgaggatgtccgcgctgaggaaggaaagaagaattgcagggatgcctgtgagatgggaggtgccgctgaaggtcttttgagattgtggacagacctgcaggaatgagaagttctccgcgaggcgctgagagggaggcacagatgcctgggggaatgaaaaggagccacagacggtggatggagagggaggaagtagttggtggagcagccagcagccctaggagcttcgagttctttattcatcattcgaatgctgtgggtataaaaacgtgccggctcaccagatggagccttatccactccacagacacacttgcgtgtcctctaagatgatccaagataatgaaatagataaatacttgttattttccttgaggtcttaaaaaatcctgcacagagaaagctgggtatgttgagtgggccgccgtggggtcggccgtttcctgtccgggcggcgcggtgcggcgtgtgattgccgcaggaagggccttcgcggccccaccacgggccgaccctgggcgcggtgtcaggtgcactttaattccccattcaacagccctgccttcttgtctaccttgcctggagccctctttctgagggtgggaagcttcggttgcctggcagatctgagtgaggatggaaccgcaccgctccacgtggggagtgagtggtacagcgtgggaggcctcagatcaggtgcctttccgagtcctcacggcagcctctgcagcaggcgtcccagccacacctgacaacctttcctggggctcactttgcgagaccctgacggatttcgtccactgtcactgccgtatcccgtcgccaa

SEQ ID NO: 5679 - DNA, 186 bp, Homo sapiens
  ENST00000633407
cgtcggtctgaggaggggccgcttcgccatgtcgccccgcacctgctgagcccggagcgtccgaggatgtccgcgctgaggaaggctttctcgccatccgaggcttggccctagccctgcgcggcttccctcgcggctgcgaaccctctgcctgcgcccagcccagccacaatggggactgctcag

SEQ ID NO: 5680 - DNA, 3380 bp, Homo sapiens
  ENST00000637795
ctgggcgccgagtgcgcaggcgccggccgtgaagaccgaccgtgcgccgggctcgagcgcggtctgagcgcgcggcgcctgcggcggcgaacggacggacggaccgcggacggacgtactgaccccaacccgcgagccccgggagccgtcggtctgaggaggggccgcttcgccatgtcgccccgcacctgctgagcccggagcgtccgaggatgtccgcgctgaggaaggttttgcctggcattctgcagaagcattgctgtatcttaccagacaggaatacagagtcgcagtgcacgctctgcggggagccggaagaggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctga

SEQ ID NO: 5681 - DNA, 811 bp, Homo sapiens
  ENST00000522092
agcgcggtctgagcgcgcggcgcctgcggcggcgaacggacggacggaccgcggacggacgtactgaccccaacccgcgagccccgggagccgtcggtctgaggaggggccgcttcgccatgtcgccccgcacctgctgagcccggagcgtccgaggatgtccgcgctgaggaaggctttctcgccatccgaggcttggccctagccctgcgcggcttccctcgcggctgctaaccctctgcctgcgcccagcccagccacaatggggactgctcaggttttgcctggcattctgcagaagcattgctgtatcttaccagacaggaatacaggccgtctccaaactatagtcctattggactggtgcaccaaatatggatttggggtgtgcgtaattcagtccatagcacccaccaaaccacagaagctgccccgagctgatgtcccgctatcggtgcggctgcaggacactgtcccattgctgcatggagcctctcgctgtctgagcctcacctgaagccggcccacaccattttcttactctatgcattggagcgaaaatgtttaattgactacgatgggtgattcctaaagttatatttgactcagaaaaaaatgcattagtaaaactccctgtttgaatgtttctagtattcacagcccgggtcactgtctttctataacgattggtatctgaaataagaacatgggctgcaacttacagccttgctctttctactatataaacttccctaatcaaatatttttcattaaaaaaatgtgtttttggaaataaacagttacaacctgg

SEQ ID NO: 5682 - DNA, 965 bp, Homo sapiens; identical to SEQ ID NO: 5678
  ENST00000520816

SEQ ID NO: 5683 - DNA, 431 bp, Homo sapiens
  ENST00000577187
cgtcggtctgaggaggggccgcttcgccatgtcgccccgcacctgctgagcccggagcgtccgaggatgtccgcgctgaggaaggctttctcgccatccgaggcttggccctagccctgcgcggcttccctcgcggctgctaaccctctgcctgcgcccagcccagccacaatggggactgctcaggttttgcctggcattctgcagaagcattgctgtatcttaccagacaggaatacaggcaatgctgtgaagcgtcagagggaattccgttggttactttcccatacggtcttgttcagctgcttgttctcagaaaagtgtgtttgttggtggaggagaatgcgaccaaggagaccatccttttcatgaaggcacaaacgtgaatacatatgtgacttttaagcctttaaataaaaacccaaagcaca

SEQ ID NO: 5684 - DNA, 3165 bp, Homo sapiens
  ENST00000421627
atggggactgctcaggttttgcctggcattctgcagaagcattgctgtatcttaccagacaggaatacagagtcgcagtgcacgctctgcggggagccggaagaggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctga

SEQ ID NO: 5685 - DNA, 1744 bp, Homo sapiens
  ENST00000524139
actgggcagaccttgctggccacggcctccacgtgcagtgaccgttctcttggcagcgtctcaggctgtctggaccagctgtcacagtctcgctgtgggtgagtcacctgaggcactgtatggcggatagaaggattcattgccctgggaggttttgcctggcattctgcagaagcattgctgtatcttaccagacaggaatacagatgaagacccccaggcccagggaattcgatcactggctgagaactcacagctaaggagggggagcctgggattccttcctggtgctcacacccgagacccttttgtcactgtgttcaaaggcactgctgcacagacgtgattcttctttcaacgaacatctccaggacttcctccggggtctgtgacctcatctataattaaagggaaagagatcttcctgagattagcccatttaacttgtttaactagatgcatgctgcaaaaactgttttcaagaaatgaacaattgactatttaaaaagagccaagccttaaaagaagaccaggttttaatagggaaaacattcagtaaaatattattctgcagtaacttgtggaatgactgctgtacacacagctctgggctgggtacctggaagctcacgagcttgtttggcctcccctcctggacacaggaggtgtcaaggctgtggtcagcagaatctacccagctggacactgagtggacgccctgtggggtggctgtgaaatgggtccactttgtagtggcagcatccctgatagtacttctgaaagggacaagatagaaaagcaaaccaaactgaaactgagaagtcgtggatgataccaggggcgcacagtggctgacaggaagagactgcctggggggtctcggagccagtggctggagtggagttagtttgaccgagtcctggactagggaggggacccccaaagcatgcccagcatggcgctagtggggcccaggcaccccatgtcccaacgactagaaccaataatcaggttaacactcattaaataagaagtgtctgtgcctcctgggataaaaatcctttataacgatctgggacgcgagctcaagtccctgttcccttgtcctccacagcagtgtgcagcgtggaactcggcggttcggggtccctgagtccctgagccactgtctaccccctgctccatcccaaatgcagagacccctgagcactcatgtggacatgccccaccatgccctggctgctccttcaggatggcgcagggccaccgctatgggaggactctaaagggtgggtctcaagccctcctctgcttaccctaaatcaggagagcaaaccgaatgcactgccctcttccttcactcctgcatcccatcccccgctatggcctcactatcaggtctgctgtgtgccaaaatattttaccatgccctaaaagtgagatgttggaagtggacaaggaggaaatatttatgaatatttgagtctgttattctttatgttaagcattttggcttctgttgtactcctaaatcactactgagagcagagaaagagctctttgtagaaatgagatgtgttcctgtgtgctgcctgtgacgcatcccgttgtcaccggagtgccgtggccctaaggaatgacagcattaaggcatggacgttaaagatggacaaaagaattgttcacggtgttgtattttaaaatgactatgtgtatgacaattaaactattgtgtcttcgttta

SEQ ID NO: 5686 - DNA, 260 bp, Homo sapiens
  ENST00000578889
aaggattcattgccctgggaggttttgcctggcattctgcagaagcattgctgtatcttaccagacaggaatacagggcctctgaagagcaccggcagcttccttcttagcagaggagaaaatctctgccatctcgtgctcgcctacctcgactcgccagacgccctggagcagaggaggagcagtggtcggcagcggccagccgtgcaggtgccacacctgatggtccacctgggagaaccaggcaggaagccggaaag

SEQ ID NO: 5687 - DNA, 381 bp, Homo sapiens
  ENST00000520524
gggcctctgaagagcaccggcagcttccttcttagcagaggagaaaatctctgccatctcgtgctcgcctacctcgactcgccagacgccctggagcagaggaggagcagtggtcggcagcggccagccgtgcaggtgccacacctgatggtccacctgggagaaccaggcaggaagccggaaagagtcgcagtgcacgctctgcggggagccggaagatacagacagcccaactaaatccttgaaatgcagcgtggcgtgaaaatggagcggcattttagttaacgagggtctggatgccattcacaggaatgcagtttctacagggttctgctttgcagagacctctcctgataataataataaatttactcagaacaa

SEQ ID NO: 5688 - DNA, 539 bp, Homo sapiens
  ENST00000522989
gggctcccgaatgagacatcctgtgttgatcgcagccgtctcccagcatgtggagcaacactaggaccgtggtagatgttcagtcatgttcgctgaaggaagaagggagtgaatgaatgtcttctctgaggatagctgagcatccgtgcatccgtctggccatgagaacttggttgcgctcacatgaggatcctgagcagagtcgcagtgcacgctctgcggggagccggaagggagagatggggagagatgatcccaacgtgtgactctaaaagccgaatactaaaggcttctgtatactcagggtcacagaagctcaaccgtgtccattggaaaggctcttactcgtaatttaaaacacaaaaatgaaaaaaagatacagacagcccaactaaatccttgaaatgcagcgtggcgtgaaaatggagcggcattttagttaacgagggtctggatgccattcacaggaatgcagtttctacagggttctgctttgcagagacctctcctgataataataataaatttactcagaacaa

SEQ ID NO: 5689 - DNA, 396 bp, Homo sapiens
  ENST00000522626
gaaaaagagtcagccttggggaactcgggacacagccaaccccaggaatgtgcctttgggtcagagcccagcccagctctgcttccacagggagagatggggagagatgatcccaacgtgtgactctaaaagccgaatactaaaggcttctgtatactcagggtcacagaagctcaaccgtgtccattggaaaggctcttactcgtaatttaaaacacaaaaatgaaaaaaagatacagacagcccaactaaatccttgaaatgcagcgtggcgtgaaaatggagcggcattttagttaacgagggtctggatgccattcacaggaatgcagtttctacagggttctgctttgcagagacctctcctgataataataataaatttactcagaacaa

SEQ ID NO: 5690 - DNA, 3515 bp, Homo sapiens
  ENST00000520901
cgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtc

SEQ ID NO: 5691 - DNA, 632 bp, Homo sapiens; identical to SEQ ID NO: 5672
  ENST00000522499

SEQ ID NO: 5692 - DNA, 709 bp, Homo sapiens; identical to SEQ ID NO: 5673
  ENST00000524065

SEQ ID NO: 5693 - DNA, 615 bp, Homo sapiens; identical to SEQ ID NO: 5674
  ENST00000518530

SEQ ID NO: 5694 - DNA, 10088 bp, Homo sapiens
  ENST00000612087
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagtt

SEQ ID NO: 5695 - DNA, 5056 bp, Homo sapiens
  ENST00000373913
cccgcagccgcatctggggcgccgcgccggccggaggagaggcatggggcgcccgcgggccggagccggggcgggggccggggcctaggcgcgcggacctgcgagcggacccgagaggcggcggcggcgcagcggaacggcagagcgggccggaggcggccgaggcgcccggcgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaccaa

SEQ ID NO: 5696 - DNA, 3337 bp, Homo sapiens
  ENST00000373907
cggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggctttt

SEQ ID NO: 5697 - DNA, 3110 bp, Homo sapiens
  ENST00000475894
acatgccaagcgggctgcgcgcgcccctgcccggcccgggagtccctgacgacgcgcgcgcggctgacgcggggggcggggaggggcggggcaggtgcgggactttaacccggagccccgcccctcgggcgtacaaaaccggagcctcgggccgggctgcgtgagggaggagggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaccaa

SEQ ID NO: 5698 - DNA, 839 bp, Homo sapiens
  ENST00000482872
gtacaaaaccggagcctcgggccgggctgcgtgagggaggagggctgtgtgaggcattgtgtaatcagccaggctctttcccgaccattgttctccaccaacaggcctggaagtcggaagccagtggagttctccctgtttcacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaa

SEQ ID NO: 5699 - DNA, 794 bp, Homo sapiens
  ENST00000495241
ggagcctcgggccgggctgcgtgagggaggagggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaa

SEQ ID NO: 5700 - DNA, 469 bp, Homo sapiens
  ENST00000491207
agcctcgggccgggctgcgtgagggaggagggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcct

SEQ ID NO: 5701 - DNA, 603 bp, Homo sapiens
  ENST00000482037
ggctgcgtgagggaggagggcccagttgtgtctgtaccagaaatgaggagtgatgccaagcctaggcctggcccagccttagcttctgcaatgcaacctatgtaatcacacccattttacaaggaggaaactggggccatacaacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagca

SEQ ID NO: 5702 - DNA, 2392 bp, Homo sapiens
  ENST00000340491
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaa

SEQ ID NO: 5703 - DNA, 577 bp, Homo sapiens
  ENST00000479220
gaaatcctggcttcccaaacccagctttcacagagcatttcactttccctgaaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactc

SEQ ID NO: 5704 - DNA, 2396 bp, Homo sapiens
  ENST00000489701
tcactttcctcttaccgaatcaggcctggacttgctttctggctgggttactttccctctgatgactggctgcctaggccagggctcagggcgtctgagggtgcttagtagaactctgggcccagcagctctgagagagaggctggagggtcagtcctttgtccagaccctgactgtgggcagtcctgttgtcttccattgggaagaaggtgtgcctcttcccaccagaacctcgtgaatgctgcatgcacactcttcatggacagtgtcatccctaccccacagatgggaacaaggactctggtgtcacacagcctaagctaggcttagtgcccagttcttgctcccccatactaactgctaccctcctaagggagatatactcccttaaacattttgagcaaattgaggttggcttccgttttctgatctagggcaaaaaaccccatttgtttgggactttaggtcaaacaaatccattcctttcctgaaatcctcagtgagttagtcctgtctctgctggtggccatagatttcaagagttgctctaaacaaacgtccaggtcttggtggaaactgtccctgggccagtcagagaaccagcccagactccctgccagtggctggggagtggtagaaatttggctcgcccccccatccccaccctacccacaggcccagttgtgtctgtaccagaaatgaggagtgatgccaagcctaggcctggcccagccttagcttctgcaatgcaacctatgtaatcacacccattttacaaggaggaaactggggccatacaacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggtgagcatggagcagtgcggaggggaagtccagggacaaattcctggtcggcaataacgctgcccacatcggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcac

SEQ ID NO: 5705 - DNA, 631 bp, Homo sapiens
  ENST00000479951
gggacgctgaccagctctgagtcccaccccgaggccgcccccaaaaggaaactgtcatcgataggaatacaagtcagctcgggtgcggaggccatagccccgcttggcggcaggagcagcatggagcatagacgctgttgggccaggggcccaggacccagggcccttgagccatgggggttgctcgaggggaactttgcccagagccctctcgggccttggggacagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagc

SEQ ID NO: 5706 - DNA, 2674 bp, Homo sapiens
  ENST00000478910
tgtcttgtttgctgagctggggaaacttgggccctgccttgtagtttttaagagtttctctaaatccagattgagtggactctccctgccctggctggacctgcagaccaaactagggcacgttcagagccatgagggaggggcagctacagtgggtgagggcgagaggggagacagggcccccccaagcccaggggttgagtcagggaggacgaggcattgtgtgttgtggcacaggctgcaagggactcctccagccacccctgagcaattggatgtggcccagctgataacaaagcactggaatgcaggagcgtgggacacaaagtggagcttgaatggaacagagaaggctcactgagcaatttcttgcagttgcctgtatttgtttcctccaagaggcagctctaggcttccacttccccatgtataaacagagagagagttggccaggagactctgctgctgttttctgggcttcttaagtgtccagtccctgcgctgcacaggtgggattctcagaaacacagagagtagcctgatcttcaacccttggtcctgaccacccatatctttgggcagccccaccctcttgctggccaaaccagacgctcttatcttcccggaaagcctaagagttaggactacccttgattcctttcacccagaaaatgacaccgggataaggactctcttaggcctgtcctgggcgtcccattccctggattcaccccagccccattcttggtctcattgcagctccttggagatccagtggtgctgcattccttgagccggcttttgccgaggggaaatgtggctgcatccctgtcccagaaagcttccctggcccctacttctctccacaaggccaagagactgaagagtccccagtttctgaggatgccctgaacccttggtgcctcatgccctagattgagtgtgggtttctccctcattcttgagtgatgataggaaagctggcctggctgccccatggcccgggacctttgtcccagagaagaaaggcaggcgcagggcatcactgttgtcctgttccacttcacaggagtggagggagtgacagctttccacttggccctgaccccagtccttcctactgctccccagggccacccagtgctaaaggtaacctcagccaagtgtgaataacgtccagggacttcggtggctcctgtgggtggcagtttctgaatctagaactgccgtccagggtttgcccttagtgcaggcgcctctggcctgccctccaggtttctgccacagggttcagggagtgatctttgcctcaagacagccgccagcttcaactacaccagataacggctgtggctttgtgtgtgtgtgtgtgttttctttctctttcgtcgtccttttttttttttctctctgatgcgtgtgaaggagaggactagaaggaacggttcccacctctcggaggacaacggacccaaagcgatcgatgtgatggcaccctcctcagagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcac

SEQ ID NO: 5707 - DNA, 467 bp, Homo sapiens
  ENST00000497862
agaagcagcgtcccctctcacagtatgtcctcccgacgggacacagactcggatacccaggatgccaatgactcaagctacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaa

SEQ ID NO: 5708 - DNA, 490 bp, Homo sapiens
  ENST00000477195
ctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggtgagcatggagcagtgcggaggggaagtccagggacaaattcctggtcggcaataacgctgcccacatcggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgatttt

SEQ ID NO: 5709 - DNA, 4881 bp, Homo sapiens
  ENST00000401952
gcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtacc

SEQ ID NO: 5710 - DNA, 5016 bp, Homo sapiens
  ENST00000339266
ggggcgcccgcgggccggagccggggcgggggccggggcctaggcgcgcggacctgcgagcggacccgagaggcggcggcggcgcagcggaacggcagagcgggccggaggcggccgaggcgcccggcgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 5711 - DNA, 621 bp, Homo sapiens
  ENST00000481143
ccaggactcccccctgagccagcctcgtagtcctgcccagatcttgatttccttagagagtgaggaaagaggggagctagagagaatcctagcagatcttgaggaagaaaacagatatacacagaagttcctgctcttcgctacaatgagggaaaaaagtggcaacatcgatagaggctagaggcagagaaattctaggcagacaagggtgggacctagcaaaaccccaccttcaagctgaaacccacagcccaaagtgagaacttctatccctgtttgctcgctctctcccagttgactctttctgaataatgtctttctacctattgaatgttgccttttcccaaaattacttatgaccctccctgccccccatcatatccctataaagaccccagactcagtaggtagaaagggagacgcagcttgactggagagaggcaacttgacttcagagggacagctggactttggaggagtgatggcttaacttcggagaagagctggctggagactgccagatgtcagggaagattacctgcccgtcctgcctcctcttcagctcccctctccactgtgagacatttccatccctaaataaaattctccacctccaccatc

SEQ ID NO: 5712 - DNA, 4645 bp, Homo sapiens
  ENST00000378723
agtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagta

SEQ ID NO: 5713 - DNA, 6773 bp, Homo sapiens
  ENST00000358062
gtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaag

SEQ ID NO: 5714 - DNA, 13932 bp, Homo sapiens
  ENST00000378677
gtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5715 - DNA, 13956 bp, Homo sapiens
  ENST00000357033
gggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5716 - DNA, 2617 bp, Homo sapiens
  ENST00000378702
cacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaattt

SEQ ID NO: 5717 - DNA, 5209 bp, Homo sapiens
  ENST00000474231
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatc

SEQ ID NO: 5718 - DNA, 2224 bp, Homo sapiens
  ENST00000361471
actttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggt

SEQ ID NO: 5719 - DNA, 1858 bp, Homo sapiens
  ENST00000378680
gctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgtt

SEQ ID NO: 5720 - DNA, 714 bp, Homo sapiens
  ENST00000378705
ttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcagagatgatgaacatttg

SEQ ID NO: 5721 - DNA, 669 bp, Homo sapiens
  ENST00000475732
ctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaa

SEQ ID NO: 5722 - DNA, 555 bp, Homo sapiens
  ENST00000469142
aaagaatcccctttcaggccacatgagaagctgcgtgttaaagccaactccataaaggggaatggaaactagcgtatgaaattcagaaatgctacttttaaaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtct

SEQ ID NO: 5723 - DNA, 671 bp, Homo sapiens
  ENST00000634285
ttcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaa

SEQ ID NO: 5724 - DNA, 655 bp, Homo sapiens
  ENST00000634315
catctcgccaaacaaagtgccctactatatcaagagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaa

SEQ ID NO: 5725 - DNA, 781 bp, Homo sapiens
  ENST00000445312
tgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggct

SEQ ID NO: 5726 - DNA, 362 bp, Homo sapiens
  ENST00000471779
gtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaa

SEQ ID NO: 5727 - DNA, 771 bp, Homo sapiens
  ENST00000488902
ctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaa

SEQ ID NO: 5728 - DNA, 616 bp, Homo sapiens
  ENST00000493412
gaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcactta

SEQ ID NO: 5729 - DNA, 303 bp, Homo sapiens
  ENST00000420596
atgctttggtgggaagaagtagaggactgttatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgac

SEQ ID NO: 5730 - DNA, 123 bp, Homo sapiens
  ENST00000448370
atgctttggtgggaagaagtagaggactgttatgaaagagaagatgttcaaaagaaaacattcacaaaatgggtaaatgcacaattttctaaggaataccagaaacacatggaaacttttgac

SEQ ID NO: 5731 - DNA, 3856 bp, Homo sapiens
  ENST00000288447
atgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaaactccgtgctttgttatctgtgattctactagttgatagattaatgcgatatgataaaatgctgtttaatatgtcttaaaaatatattttagatagcaagcaaaatcaaagtttagcctagagaaatctttctggattcttctgtgactgactagggatgcctttcataaacttgccttaacttacatattatttaactataaattaacaattttatgacattaattcatgttgattcctttcatatattgttcagttacctcaaggctaggccttagcaagcttgcacaattgtgtagagtagaatagagtaaaatagaatagaataatataatagataccatacttaggactatgtctatattctcactgttatcaaaaagttattctttatagtcatcaatccctgtcatatattataagatatttaaatttcccagatatttgtgtattaccttatctaaaaggtgtccagcctttctcagtatttacatgtggtagcagatgctttgttgttgttattcccttctgagatggtataattttgaccttcacaaataggaagttttattaatttaatataaagtgtttcatctttagggaaattgtcaaggctttaatttttcaacttcaacaattataaaacatgcatctttgtatatgattggcaacagtttgtaaaataatttctaacaggcagagtaaataaaatgggcaagctaaggaagcagtgattatgaatgaaaagtaattttatccatgggaagatcacatctaaatgtgtatattagctctgctttttctctccaggattcaaatcatgaagttcaaaatccattgtatttttacaaatacgacattacctcagttacaagctaatgtttgctgttggggttggaacttttggagatcaacaaaagatatatatatattctggaaaaaaaatctattttttaggctgcttgaaaaagggaagacaattttgtcaccagttcttcttagagttaactacttataaattggaaagctattttaaattacttattagctttataagacatgctgttgtcagcattataatagactattctaaattgtttcaagaaatgggaaatatgaaaactgaaagataatatataattgtagaaaattagctaaatgtcttttttcaagtatacttctttgaaggtaaattgtttgctgtgatttttgagggaaattctcttagtagtagaaaattaattagagaacattaaactctaattttcaaacatcatgttacatatttgaccactgaaagtatgaatcacctttagcattttattagctaattaaaaatgattattgatctgattctcaca

SEQ ID NO: 5732 - DNA, 234 bp, Homo sapiens
  ENST00000480751
cgtaattatccacaggttaatgtaatcaacttcaccaccagctggtctgatggcctggctttgaatgctctcatccatagtcataggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaaca

SEQ ID NO: 5733 - DNA, 375 bp, Homo sapiens
  ENST00000447523
gagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtattgggagatcgatgggcaaacatctgtagatggacagaagaccgctgggttcttttacaagacatccttctcaaatggcaacgtcttactgaagaacagtgcctttttagtgcatggctttcagaa

SEQ ID NO: 5734 - DNA, 371 bp, Homo sapiens
  ENST00000472681
gttttttcaagaagcaggattcaaggtttaacttcaaatacaaatttgaatcaacactaaattttaggagtgcataatgaaagagaagatgttcaaaagaaaacattcacaaaatgggtaaatgcacaattttctaaggtctgtgcaggccaaggttatggcctagctgagaagagggctcagaggagcctagctaaagtttggtcaaggggagcgtcttggtggagcctcactcctgttcaagtaaagaagacacattattcatccttctgaacagttttgggaagcagcatattgagaacctcttcagtgacctacaggatgggaggcgcctcctagacctcctcgaaggcctgacagggcaaaaactg

SEQ ID NO: 5735 - DNA, 380 bp, Homo sapiens
  ENST00000472266
tgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctggtgagtaaaagctgcagataaatgcaacagccattcagaagaatgataaattccacaagcattcagaagcaggcttccctaaagatgaaagagaagatg

SEQ ID NO: 5736 - DNA, 554 bp, Homo sapiens
  ENST00000463609
tttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttgaaaatggatgaagctggaaaccatcattctcatcagactaacacaggaacaggaaaacaaacaccgcatgttctcactcataagtgggagttgaacaatgagaacacatggacacagggaggagaacatcacacactggggcctgttggtgggtgaggggctatgggagggatagcattaggagaaatacctaatgtagatgatgagttgatgggtgcagcaagccaccatggcatgtgtatacctatgtaacaaacctgcatgttctgcacatgtatcccagaatttaaagtataataaaaaaaaaattgaggtctgcaacaggcaaagccactaaagaaactcagatatttttcattgtaatgttgaaaaagttatgaaatttcactaagcccgtgtcta

SEQ ID NO: 5737 - DNA, 7410 bp, Homo sapiens
  ENST00000378707
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5738 - DNA, 5623 bp, Homo sapiens
  ENST00000343523
gggttttctcaggattgctatgcaacaggatcagtgctgtagtgcccggttcaagctgaaaatgttacacaggaagacataccatgtaaaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5739 - DNA, 7080 bp, Homo sapiens
  ENST00000541735
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5740 - DNA, 7339 bp, Homo sapiens
  ENST00000359836
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5741 - DNA, 13734 bp, Homo sapiens
  ENST00000619831
atgtctgaggtctcatctgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttttgttttttcgaaacataccttttgcctccagaggcaaaagacgggtgaggaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5742 - DNA, 13746 bp, Homo sapiens
  ENST00000620040
atgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttttgttttttcgaaacataccttttgcctccagaggcaaaagacgggtgaggaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5743 - DNA, 3106 bp, Homo sapiens
  ENST00000255189
gcgcctgcgccctcggcctcggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagcaggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataagccagcagacttcataggaaagcaagcactgaaacagattaaagccaaggggctgaaacgaagactggtctgcctcaccttggcaacggatgatgttgatccagagggaaatgaaagcatctggtacaatggcaaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatga

SEQ ID NO: 5744 - DNA, 2777 bp, Homo sapiens
  ENST00000523732
tatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggcccttgcttccttccgtcttggagttgttccagcctccttcccctgctgttggcttatgtgaagttgatacacatgtatcattcattcatccgttcatctagtagacatttattaagtaccgctgattagacaccttgctaacccatagatctaaatgttaaagatatactcctgatggctctcagatctcatgaacctggaaacaaataatatttcaggaactaaagctgtagggatacgttcttagccgtaattgtgaagataacccttccgcaagtggagggctctccagccgcatacaacactgccatcttgtgggaagtgctccgtagagccacttcaggaagccttgaccaaagctgcggtaaaaataattgaatctgtacttttaaaatcttcttaactaaaaacgcttcacctgaaacgactcatatcattgttctcaatggtatttttggtatgttccaaaggaagtaacttttgggaggaaaatcagtagcctttgtttagttggagatggaagaaatgcattaatcaagagcaaaaggaaaatcagctgcctttggatggagtcataggcattcctggaattttcatggtggaaatattgaatttttgtccatttctggagaacctccacgaagattcacagagactcaagtattaaacgtaatgtgttgaagcacatcagaagaatttgttttctataatatgtttctccctctttttctcactctctccttctccctctctttccctttttctctctccttcccctctctccccgtgtagagcttctaactagtagaaacagaataaaatgtaatctctattaaa

SEQ ID NO: 5745 - DNA, 1966 bp, Homo sapiens
  ENST00000518477
ggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggccct

SEQ ID NO: 5746 - DNA, 1517 bp, Homo sapiens
  ENST00000517853
ggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcaatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggccc

SEQ ID NO: 5747 - DNA, 583 bp, Homo sapiens
  ENST00000523201
agtggtgtgatctcggctcactgcaaccttcgcctcccaggttcaagcaattctcctgcctcagtttcccaagtagctgggactacaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcc

SEQ ID NO: 5748 - DNA, 554 bp, Homo sapiens
  ENST00000521052
aggctgcccgctggcctcggagcaggcgcctgcgccctcggcctcggcctagtcatgctccgtcccggcgcgcagctgctgcggggcctcctgctgcggagctgcccgctgcagggctcccccgggcgcccgcgctctgtctgcggccgggaagggtttaacaacttactttcatcctggaataaacttgaagaaaatacattatgatagcatcaaactttatgagaaactggaagaagaaactggtcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaa

SEQ ID NO: 5749 - DNA, 572 bp, Homo sapiens
  ENST00000524206
ctagtcatgctccgtcccggcgcgcagctgctgcggggcctcctgctgcggagctgcccgctgcagggctcccccgggcgcccgcgctctgtctgcggccgggaagggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcag

SEQ ID NO: 5750 - DNA, 661 bp, Homo sapiens
  ENST00000520388
gcgccggcgcctcctctcggcgtcccctgagccagcccgcgagcggccgcgctcccgactctccttccttccgcgcagcctccagttccccggggctggagccggctgtcggctggttgccggctccgagggcgatgagagtggcaggtgtgccctgctgcacaggtggcctccgaacccgggaaaagaggaactaaggcggaggaactgagacgtttcgaattccaggcgcactgcacactcgccggggggcacgccatgcaaatctccttctgggccaatgcacatggttgctgccacaggtttaccggatgctatcaaggtttcaactgcccacacagcttcttcaacgtgttcaaaatactggaatcagttaagctaaggtatgaaggtgtctgactcactcctcctgctaccaaagcatctccttcatcagccacttgtcgggcgatgtcgcaagcagcttcattgacttcctgcccctaaaatggagacggggtctccctgcattgcccaggatggactggaattcctggcctgatacgatcctcctgccttggccactcaaagtacatccttaacacccctctatggctgtacattcaggcaggtttaacaacttactttcatcctggaataaacttgaagaaaatacattatg

SEQ ID NO: 5751 - DNA, 455 bp, Homo sapiens
  ENST00000518707
gccggctgtcggctggttgccggctccgagggcgatgagagtggcaggtgtgccctgctgcacaggtggcctccgaacccgggaaaagaggaactaaggcggaggaactgagacgtttcgaattccaggcgcactgcacactcgccggggggcacgccatgcaaatctccttctgggccaatgcacatggttgctgccacaggtttaccggatgctatcaaggtttcaactgcccacacagcttcttcaacgtgttcaaaatactggaatcagttaagctaaggtatgaaggtgtctgactcactcctcctgctaccaaagcatctccttcatcagccacttgtcgggcgatgtcgcaagcagcttcattgacttcctgcccctaaaatgggtgagtatatgagacatctaaattttcatgtgaaattgaaataaaattattattcaaacattca

SEQ ID NO: 5752 - DNA, 550 bp, Homo sapiens
  ENST00000520855
agcccgcgagcggccgcgctcccgactctccttccttccgcgcagcctccagttccccggggctggagccggctgtcggctggttgccggctccgagggcgatgagagtggcaggtgtgccctgctgcacaggtggcctccgaacccgggaaaagaggaactaaggcggaggaactgagacgtttcgaattccagatggagtctggctctgccgcccaggctgaagtgtggtgcaatcccagctcactgcaatctccgcctcccgggttcaaatggttctcctgcctcagcttcccaagtagctgggattacaggctggagtgcaatggcatgagcacagcccactgaagcctcaacctcccgggtcaagcaatcctcccacctcagccttcctagtagctgggactgtaggtgtgcaccaccacgcctggctaatctttgtattttttgtagagatggggttttgccataggctgttttcttctattctatggttctcataatactactttgtaacaagccattctaagatttaaagtgatgcaaaaac

SEQ ID NO: 5753 - DNA, 2682 bp, Homo sapiens
  ENST00000339673
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggagagcagtgagtcatcagaaggcagtaaagttagctcagaggaacaggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccgggaaattctattcttgggataaataatagtaaattctataggattcaatacttagtttgcaaaagcactttgaaattatggcacagtgagttgttttggataagaaaatctttttctcccaattaatttaccaattcatcatttttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaa

SEQ ID NO: 5754 - DNA, 2634 bp, Homo sapiens
  ENST00000282479
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccgggaaattctattcttgggataaataatagtaaattctataggattcaatacttagtttgcaaaagcactttgaaattatggcacagtgagttgttttggataagaaaatctttttctcccaattaatttaccaattcatcatttttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaa

SEQ ID NO: 5755 - DNA, 15633 bp, Homo sapiens
  ENST00000265104
agtaaaactttccatttggaagcctgttggatgttgagcaggtctgccaggagttagaagaccattccggaagagctgactccagcctgtccatgcacggctacaatgtttaggattgggaggagacagctctggaagcatagcgtcactcgagttttaacgcaaagactgaagggagagaaggaagccaagcgggctcttttggatgcgaggcataactacttatttgcaattgtggcttcctgtttggacctgaacaaaaccgaagtggaggatgccattcttgaagggaatcagattgaaagaattgatcaactttttgctgttggaggtctccgacacctcatgttttactatcaagatgtggaggaagcagaaacaggacaacttggctctctaggaggggtaaatcttgtttctggaaagattaaaaaacctaaggtgttcgtgaccgagggaaacgatgtggctcttactggggtatgtgtgttcttcatcaggactgacccttccaaagccatcacccctgacaacatccaccaggaggtgagttttaacatgttagatgcggcagatggaggcctgctcaacagtgtgagacgtttgctgtcggacatcttcattcctgctctcagagccacgagccatggctggggcgagctcgagggccttcaggacgcagctaacattcgccaggagttcttgagctccctggaaggctttgtgaacgtcctgtcgggtgcacaggagagtctgaaggagaaggtgaaccttcgaaagtgtgacatacttgaactgaaaaccctaaaggaacctacggactacttgactctagcaaataaccctgagactttgggaaaaatagaggattgcatgaaagtatggatcaaacagacagaacaggttcttgctgaaaacaatcagctgctgaaggaagcggatgacgttgggccacgagcggagctggagcactggaaaaaaagactctccaagtttaactaccttttggaacaattgaaaagcccggatgtgaaggctgtgctggcagtgcttgcggcggccaagtcgaaactgctgaagacttggcgggagatggatattcgaatcactgatgcaactaatgaagcaaaggacaatgtgaaatacttgtatacacttgaaaaatgttgtgaccctttgtacagcagtgatcccctatccatgatggatgctattcctacacttataaatgcaattaaaatgatctatagtatctctcattactataatacctctgagaagatcacatctctgtttgtaaaggtgacaaatcagattatatctgcatgtaaagcctatattaccaataatggaaccgcttccatctggaaccagccacaggatgttgttgaagaaaaaatactatctgcgattaaactgaaacaggaataccagctctgctttcacaagacaaaacaaaagcttaaacaaaatccaaatgcaaaacaatttgattttagcgagatgtatatttttggaaaattcgaaacttttcaccgacgccttgccaagataatagacatctttacaaccctcaagacgtattcagtcctgcaagattccacaattgaagggctggaagacatggccactaaataccagggcattgtggcaaccataaagaaaaaggaatacaatttcctagaccagcggaaaatggattttgaccaagattacgaagagttttgcaagcagactaatgaccttcataacgagttgcggaagttcatggatgttacatttgcaaagattcaaaacacaaatcaagctctaagaatgttgaagaaatttgaaagattgaatatacctaatcttggtattgatgacaaatatcaacttatccttgagaactatggggctgacattgatatgatttcaaagctgtatacaaagcagaaatacgatcctcctctggctcgaaaccagcctcccatcgctggaaagattttgtgggcccgccagctcttccataggattcagcagcccatgcagcttttccagcagcacccagctgtgctaagcacggcagaagccaaacctataattcgcagttacaacaggatggccaaggtcctcctggagtttgaggtcctcttccacagggcgtggcttcggcaaattgaagaaattcatgtaggtcttgaggcttcattattggtgaaggctccaggcacaggggaattgtttgtaaactttgaccctcagatattaatcttatttagagaaacagagtgcatggcccagatgggtctggaagtctctccactggcaacttccctcttccagaaacgagatagatacaaaaggaacttcagtaacatgaagatgatgctagctgaatatcagagagtgaagtcaaaaatacctgctgccattgagcaattgattgtccctcacttggccaaagtggatgaagctctccaacctggcttggctgcactgacctggacatcactgaatattgaggcttatttagaaaacacttttgcaaagatcaaggacctggagttgctgcttgacagggtcaatgatttgattgagttccgcattgatgccattctagaagaaatgagcagcacgcctctttgtcagcttccccaggaggagccactaacctgtgaagagtttctccaaatgacaaaggatctttgtgtaaatggtgcacaaatactacattttaaaagctcattagtggaggaggcagtcaatgagcttgtaaatatgttgctggatgtggaagttttatctgaagaagaaagtgaaaaaatatccaatgagaatagtgttaattacaaaaatgaaagttcagcaaaaagagaagaaggaaattttgacaccttgacatcatctattaatgccagggccaatgccctgcttttgacgacagtcacgaggaaaaagaaagaaactgagatgttaggggaagaagcccgcgagttactctctcatttcaaccatcagaacatggatgctcttctgaaagttacaaggaatacactagaggccattcgcaaacgtattcattcctctcacacaattaacttccgggacagtaacagtgcctctaacatgaagcagaacagtttgcccattttccgggcaagcgtcactctggccattcccaacatcgtcatggcccctgccctggaagatgtacagcagaccctgaacaaagccgtggagtgcatcatcagtgtccctaagggggtcagacagtggagcagtgaactgttgtccaagaaaaagatacaagaaagaaaaatggctgctttgcagagtaatgaagacagtgattctgatgttgaaatgggagaaaatgaacttcaagataccttggagatagcatctgtaaatttacccattcccgtgcaaaccaagaactattataagaatgtttctgaaaacaaagagattgtaaaattagtttctgtgcttagcacaattatcaactccaccaaaaaggaagttattacatccatggattgcttcaaacgctacaatcacatttggcaaaagggaaaagaagaagccattaagacatttattacacagagccccttgctttctgaatttgagtcccagattctctatttccaaaacctagagcaggaaattaatgctgagcctgaatatgtctgtgtgggttccattgctctgtacacagctgacttgaagttcgccctgactgctgagacaaaggcctggatggttgtcattggacgccactgtaacaaaaaataccggagtgagatggaaaacatttttatgcttattgaagaattcaataagaaactaaatcgtccaattaaggacctagatgatattcggattgcaatggcagcgctgaaagaaataagggaggagcaaatctccattgactttcaagtaggacctattgaggaatcttatgccctgcttaacagatatggacttctgatagcaagggaagagatagacaaagttgatacactgcactatgcttgggagaagctgctggcacgtgctggcgaagtccagaataaattagtctcactgcagcccagtttcaagaaagagcttattagtgctgtggaggtattcctccaagattgtcaccagttttatctggactatgatttgaatggtccaatggctagcggcttgaagccccaggaagccagtgacaggcttatcatgtttcagaatcaatttgataatatctatcggaaatacatcacatatactggaggagaggagctttttggcctgccagctacacagtatcctcagcttcttgaaataaagaagcaactaaatcttctacagaaaatatatactctgtacaacagtgtcatagaaactgtaaatagctattatgatattctttggtcagaggtgaatattgaaaaaattaacaatgaactcttagaattccagaacagatgtcgaaagcttccccgggccttgaaggactggcaggcttttttggacctgaagaagatcattgatgatttcagcgagtgttgcccgctgctggaatacatggccagtaaagccatgatggagcggcactgggaaaggataaccaccctcaccgggcacagtctggatgtggggaatgaaagctttaagttaagaaatatcatggaggcacctcttctgaaatataaagaggaaatagaggacatctgtatcagtgcggtgaaagagagagacattgagcaaaagctgaagcaagtgattaatgaatgggacaataaaacattcaccttcggcagctttaaaacccgtggagagctcctcttgagaggagacagtacctcggaaatcatcgccaacatggaggacagcttgatgttgctgggatccctactgagcaacaggtacaatatgccattcaaagcccagattcaaaaatgggtgcagtacctttccaactcaacagacatcatcgagagctggatgacggtgcaaaacctgtggatttatttagaagctgtctttgtgggaggagacattgccaagcagctgcccaaggaagccaagcggttttctaacatagataaatcttgggtgaagatcatgactcgggcacatgaagtgcccagtgtagtccagtgctgtgttggagatgagaccctggggcagctgttaccacacttgctggaccagttggaaatatgccagaaatcccttactgggtacttggagaaaaaacgactgtgctttcctcggtttttcttcgtctcagatcctgcccttctagagattctggggcaggcgtcggactcccacactatacaggcccatttgctgaatgtgtttgacaacattaaatctgtcaagttccacgaaaagatctatgatcgaattctgtcaatttcctctcaagagggtgagacgattgaattggataaacctgtcatggcagagggcaatgtggaagtttggcttaattctcttttggaagaatctcagtcctcattgcatcttgtgattcgccaggcagccgcaaatattcaagaaacaggtttccaactaactgaatttctttcatccttccctgctcaggttggattattaggaattcagatgatatggacacgggattcagaagaagcccttagaaatgccaagtttgataaaaaaatcatgcagaaaactaatcaggctttcctggagctactcaatacattgatagacgtcaccacgagggatctgagttccacggaacgagtgaaatacgagactctgattactattcatgtgcaccaaagggatatctttgatgacctgtgtcatatgcatatcaagagtcccatggactttgagtggctgaaacagtgcagattttactttaacgaagattctgacaagatgatgattcacatcacagatgtggcgttcatataccagaatgaatttttaggctgcactgacaggcttgtaataactccacttacagacagatgttacatcacgctggctcaagctctgggaatgagcatggggggagcccctgctggacctgcaggcacaggcaaaacagaaaccactaaagacatgggacgatgcctcgggaaatacgtcgtggttttcaattgttcagaccagatggatttccgaggacttggacggatttttaagggactggcacagtctggatcctggggttgttttgatgaatttaaccgtattgatctaccagttctctcggttgcagcccagcaaatttccattattctgacatgtaaaaaggagcacaaaaagtcttttatctttactgatggagataatgtgactatgaaccctgaatttgggcttttcttaaccatgaatcctggctatgccggacggcaggaactccctgaaaacttgaagattaatttccgctcagtggccatgatggtgcctgaccgtcagattatcataagggtgaagttggctagttgtggcttcattgacaacgttgttttggccaggaagtttttcacgctctacaaactgtgtgaggagcagctttctaagcaggttcattatgactttggcctgcgtaacattctgtcagttcttcggaccttgggagcagcaaaaagagccaatccaatggatacggagtccacgattgtcatgcgtgtactacgggacatgaatctttctaaactgattgatgaggatgaacccttgtttttgagtttgattgaagatctctttccaaatattcttctggacaaggcaggttaccctgaactggaagcagcaattagtagacaggttgaagaagctggtttaatcaaccatcctccttggaaactgaaggtcatccagctattcgaaacgcagagagtgcgacatgggatgatgactctggggcccagtggggctgggaagaccacctgcatccacaccttgatgagagccatgacagattgtggaaaaccacatcgggaaatgaggatgaatcccaaagcgattactgccccacagatgtttggtcggctggacgttgccacaaatgactggactgatgggatattttctacgctttggaggaaaacattaagagcaaagaaaggggaacatatctggataattcttgatggtccagtagatgccatctggattgaaaatctgaattctgttttggatgataacaaaactctaacccttgccaatggtgatcggattcccatggctccaaactgcaagatcattttcgagcctcataacattgacaatgcttctcctgccaccgtctcaagaaatggaatggttttcatgagctcttctatccttgattggagtcctattcttgagggttttcttaagaaacgctcacctcaagaagcagaaattcttcgtcagctgtacaccgagtctttcccagacttgtatcgcttctgtatccagaacttagaatacaagatggaggtgctggaggcctttgtcatcacacagagcattaacatgcttcaaggcctgattcctctgaaggagcaaggcggggaggtgagccaggctcacctggggcggctgttcgtgttcgcgctgctgtggagcgcgggggcggcgctggagctggacggacggcgccgcctggagctctggctgcgctctcggcccacagggacgctggagctgccgccgccagcggggcccggggacaccgccttcgactactatgtggcgcccgatggtacatggacgcactggaacacgcgtacccaggaatacctgtatccgtctgataccaccccagagtatggttctattctggtgccaaatgttgacaatgtgaggactgactttctaattcaaaccattgctaaacagggcaaggctgtgctattaattggtgaacaaggaacagccaaaacagtaataattaaaggatttatgtcaaaatatgatcctgaatgtcacatgatcaagagtctgaatttttcttctgcaaccaccccactgatgttccagaggacgatagagagctatgtggataaacgaatgggtacaacatatggccctcctgcgggaaagaagatgactgtttttattgatgatgtgaatatgccaataatcaatgagtggggagatcaggttacgaatgagatagtgcgacagctgatggaacaaaatggattctataatctagagaagcctggggagttcaccagcatcgtggacatccagtttttggcagccatgatccatcctggtggtggacgcaatgacataccccaaagactcaagaggcagttctctatatttaattgcacgttgccctctgaagcttctgtggacaagatctttggtgtgattggggtaggccactactgtactcagaggggtttctcagaagaagtgagagattctgtgacaaaattggtgcctctgacacgccgactatggcagatgaccaagattaaaatgcttcctacccctgcaaaattccattatgtgtttaacctacgagatctttctcgggtctggcagggaatgctgaacactacttcagaggtcatcaaggaaccaaatgatctgttaaagctgtggaagcatgagtgtaaacgtgttatagctgaccgtttcacagtgtccagtgatgtgacctggtttgataaggctttagtaagtttggtagaggaggagtttggtgaagagaaaaaactcttggtggattgtggaattgacacatattttgtggatttcttgagagatgcacctgaagctgcaggtgaaacatctgaagaggctgatgctgaaacacctaaaatttatgagccaattgaatcttttagtcacctaaaagagcgtctgaatatgttcctgcagctctataatgagagcatccgtggcgccggcatggacatggtgttctttgcagatgccatggttcacttagtcaagatctctcgtgtcattcgtactcctcagggaaatgccctcctggtcggggtgggcggatcaggaaagcagagcctgacgaggttggcttcattcattgctggctacgtttccttccagatcactctgacgagatcctacaacacatcaaatctgatggaagatctgaaggttttgtatcgaacagctggtcagcaaggcaaaggaatcacttttattttcacagacaatgagattaaagatgagtcatttttggaatatatgaacaatgttttatcatcaggtgaggtctctaacctatttgctcgagatgaaattgatgaaattaatagcgacctggcatcagtcatgaaaaaagaattccccaggtgccttcctaccaatgagaacctgcacgactacttcatgagtcgggtccgacagaaccttcatattgtgctctgcttctcgccagtgggggagaaatttcgaaacagagctttgaagttccctgccctaatttcaggatgcacaattgactggttcagccgatggcccaaagatgctttagttgctgtgtctgaacacttcctcacttcctatgatattgactgcagtttggaaatcaagaaggaggtggtccaatgcatgggctccttccaggatggggtggctgagaagtgtgttgattattttcagagattccgacgttctacccacgtgacgcccaaatcatacctctcctttattcagggctataagttcatatatggagaaaagcatgtggaggtgcggaccctggccaacagaatgaatactggattggaaaagctcaaagaagcttcagagtctgttgcagccttgagtaaagaactggaagcgaaagaaaaggagctacaagtggccaacgataaagccgacatggtcttaaaagaagtgacaatgaaagcacaggctgctgaaaaggtcaaggctgaggtacagaaggtgaaggacagggcccaggccattgtggacagcatctctaaagacaaagccattgctgaagaaaaactggaagcagcaaaaccagctttagaagaggcagaagctgcattgcagaccatcaggccttcggacatcgccactgttcgcacgttgggccgcccccctcacctcatcatgcggatcatggattgcgtactgctgctgtttcaaaggaaagtcagtgctgtgaaaattgacctggaaaaaagctgtaccatgccctcctggcaggaatccttaaaattgatgactgcagggaactttttacagaacttacagcaattcccaaaagacacaatcaatgaagaggtgatagaatttttgagtccttactttgaaatgcctgactataacatcgaaactgctaaacgcgtatgtggaaatgtagctggtctttgttcctggacgaaagctatggcttccttcttttctataaacaaagaagtactgcctctgaaggccaacttggtggtgcaagagaatcgccatctcctggccatgcaggatctgcagaaagcccaggccgagttggatgacaagcaggcggaacttgacgtggtgcaggctgagtatgaacaggccatgactgaaaagcagaccttgcttgaagatgcagagcgatgcagacacaagatgcagacagcttccacgctcatcagtggcttggcaggtgaaaaagaaagatggacagagcaaagccaagagtttgctgcacaaactaaaagacttgtaggggatgtactgttggctacagcttttctatcttattctggtccatttaaccaagagtttcgtgatcttctgttaaatgactggcggaaggaaatgaaagcccggaaaattccatttggaaagaacctaaatctcagtgagatgttgattgatgctcctactattagtgaatggaacctccaaggtctgccaaatgatgacttgtccattcaaaatggaattattgtcacgaaggcatctcgttaccctttgttaattgatccacagactcaaggcaagatctggattaaaaataaagaaagccgaaatgaactccagatcacgtctttaaatcacaagtacttcagaaaccacctggaagacagcctttctcttggaaggcctttgcttattgaagatgttggagaggaactagatccagcactagataatgttttggaaagaaacttcattaaaactgggtctacctttaaggtgaaagttggtgacaaggaagtagatgtgttggatggctttagactctacattaccaccaaattgcctaacccagcctacacccctgagataagtgcccgtacctccatcattgacttcactgtcaccatgaaaggtctagaagatcagttactggggagggtcattctcacagagaagcaggaattggagaaagaaagaactcatctgatggaagatgtaactgcaaacaaaagaaggatgaaggaactagaagataacttgctttaccgcctgacaagtacccaggggtccctggtagaagatgaaagtctcattgtcgtgctgagtaacacaaaaaggacagccgaggaggtgacacagaagctagaaatttctgctgagacagaagttcaaattaactcagcccgggaggaatacagacctgtggctacgcggggcagcatcctctacttcctcattactgagatgcgcttggttaatgagatgtatcagacttcgcttcgccagtttctgggcttatttgacctttccttagccaggtctgtcaagagcccgattacaagcaagaggattgctaatatcatcgagcacatgacctacgaggtttataagtatgctgcccgagggctgtacgaggagcacaaattcctgttcaccttgttgcttaccctaaagattgacatccagaggaaccgagtcaagcatgaagagtttctcactcttattaaaggaggtgcctcattagaccttaaagcttgtcctccaaaaccatcaaaatggatcctggacataacatggctgaatttggtggaacttagcaaactcagacagttttcagatgtccttgaccagatatcgagaaatgagaaaatgtggaaaatttggtttgataaggaaaacccggaggaggaacctcttccaaatgcctatgataaatctcttgactgcttcagacgtcttctccttattagatcctggtgtcctgacagaaccatcgcccaggcccgcaagtacatcgtggactccatgggagaaaaatatgccgaaggtgttattttagacttggagaagacgtgggaggaatctgatccacggacgccactcatctgtctcctgtctatgggctcagaccccacagattccatcattgccttggggaagagattaaaaatagaaacccgttatgtgtccatgggccagggccaggaagtccatgctcggaagctcttgcagcagaccatggcgaacggaggatgggcacttctgcagaactgccatctgggacttgatttcatggatgagctgatggacataatcatagaaactgagcttgtacatgatgcgttccgcctctggatgaccaccgaggctcataagcagtttcccattacactccttcagatgtccattaaatttgccaacgatcctccacaaggactccgggcaggactgaaaagaacatatagtggtgtcagccaagacctgctggacgtgagctctgggtcccagtggaagcccatgctgtacgcagtggctttcctgcactccactgtccaggagaggcgcaagttcggtgccctggggtggaatatcccctacgaatttaaccaagcggactttaatgccactgtgcagttcatccaaaaccacttggatgacatggatgtcaaaaagggtgtctcctggaccaccatccgctacatgataggagagattcaatatggaggcagagtcactgacgactatgataagagattgttgaacacatttgctaaggtttggttcagtgaaaatatgtttggaccagatttcagtttttaccaaggatacaatattccaaaatgcagcacagtggataactatcttcagtatatccagagtttgcctgcctatgacagccctgaggtgtttgggctgcaccccaatgctgacatcacctaccagagcaagctggccaaggacgtgctggacaccatcctaggcatccaacccaaggacacctctggtggaggggatgagacccgggaggcggtggtggcccggctggctgatgatatgctggagaagctgcccccagactatgtcccctttgaagtaaaagagaggctgcagaagatggggccattccagcctatgaacattttcctcaggcaggaaatagacagaatgcaaagggtactcagccttgtccgcagcaccctcactgagctgaaacttgctattgatggcaccatcatcatgagcgaaaatctgcgagatgcattggattgcatgtttgatgctagaatccctgcttggtggaaaaaagcttcttggatttctagtacactgggtttctggtttactgaacttatagaaagaaacagccagtttacctcgtgggttttcaatggccgacctcactgcttttggatgacgggtttttttaacccccagggatttttaactgcaatgcgacaggaaataactcgggccaacaaaggctgggctctggacaatatggtgctttgcaatgaagtcaccaaatggatgaaggacgacatttctgcccctcccacagagggtgtctatgtctatggcttatatcttgaaggtgctggctgggacaagaggaacatgaaactcattgaatcaaagccaaaagtgctctttgagttgatgcctgtcataaggatttatgcagaaaacaatactttacgagatcctcggttttactcctgtcccatctataagaagccagttcgaacggacttgaactacattgccgctgtggatctcaggacagcccagacccctgaacactgggtgctccgtggggttgcccttctgtgtgatgtcaagtaacatgtggggagtgtccccacccaatgctttggaaaatgcaagatctaaattattgtaacctttatttctgtatgactgctggacagtgtatgttaggtcgtttatgcaattaatgagctgcataggttttccccactccttaattggatgcttatattttacttgtttcatcattagtgaccaatgtctgagtttgttgaaaatgttatttagtgatataaaagtaaatttacagcatcctaatgaagtgtggccctcaaatccacagtagtatattttcttcttacttcgctccgaagactgactagggtaagcagacagtatttctctgggaggaattattcttctgttaacgtggcctggtaacagccaagttcttgaaggtaacagggcaagtctgtgctgattttgcttctattgcctttcgtatttaggtcaagttaagagacttattttcagggtttcaagcagccaattaaaaataccttttaaaaaatagaaggaaatagaagaatggattaagaatgtaaatagaaaatttatgtaaacatagagaataaacgtagaacaatgcttaagcctacttataattaataatgaaatactaattgataattcttataataaaaattaaagctaaaagtaaatgatagcatgctctcagtaaaactgatccactcacaaattgctggagcaatgtaaatcaacccaacctttttgtaaaatgattaaatacagaaagagccataaaaatattcacacccttggatctttgttttctctacatcaaggaaacaatttaaaagactgaaaacagtctatataaaattgcatttaataacagaaaaaaatggaaaaatcataaatattcaatagtcaggctatggttaaggaaattaagagatatttggcaaccataaaaaacaattttgaagattccataatatgaaatggtagacccagactgttaagtgaaagatttagtttacaaaatattgagcacactgtgattataacagcaaatatatttgcatgtggacaaagattagatggcaagatagaaaaataagaacagatgtgatagcaagaattatagttggcttgaaaaaatgtgatgatcaggagaaaaaataaaaaaagggtagaaatattagacggtgcgtagggactttctatggacttttattaattaggaaacattatcaaaggaacttttcacgtatttttctttaaattctggttagatgttattaataattcttcatctaacctactgactagaaaatatagtcagtactaaattagaattgtggtttataaacttttggttagctctggatctgtataactgcatttttttggataaacagtttttggtaggtggataccgggagacaagtgtgggtccctctcactgggcttcattctgtggaccaggatcattatttcatgctcatgatcatgagagttaggactgagtggctcctgtgactcccaccatcttagatgatactgttttcttgtgagttctttcttttggtgtggattagtatatcagttgatttgtgtgaattgtggtgaaacaatcatttcattttgaaaagcaagtaatgaaaatgtcaacatcataggaattaataaaatgtttttact

SEQ ID NO: 5756 - DNA, 760 bp, Homo sapiens
  ENST00000504001
aaacaggttggctgctgaccagaacctgcagctgtgtagaagagatgtctctgcacaagcaccaggcaacaaagagtgttgatagtgtctgaacacttcctcacttcctatgatattgactgcagtttggaaatcaagaaggaggtggtccaatgcatgggctccttccaggatggggtggctgagaagtgtgttgattattttcagagattccgacgttctacccacgtgacgcccaaatcatacctctcctttattcagggctataagttcatatatggagaaaagcatgtggaggtgcggaccctggccaacagaatgaatactggattggaaaagctcaaagaagcttcagagtctgttgcagccttgagtaaagaactggaagcgaaagaaaaggagctacaagtggccaacgataaagccgacatggtcttaaaagaagtgacaatgaaagcacaggctgctgaaaaggtcaaggctgaggtacagaaggtgaaggacagggcccaggccattgtggacagcatctctaaagacaaagccattgctgaagaaaaactggaagcagcaaaaccagctttagaagaggcagaagctgcattgcagcaattcccaaaagacacaatcaatgaagaggtgatagaatttttgagtccttactttgaaatgcctgactataacatcgaaactgctaaacgcgtatgtggaaatgtagctggtctttgttcctggacgaaagctatggcttccttctttt

SEQ ID NO: 5757 - DNA, 676 bp, Homo sapiens
  ENST00000512443
catgatccgcccgcctcggcctcccaaagtggtgggagtacaggcatgagccaccgtgcccggccaaccctattatgtttaaaggcagcttgctattctcagagatcagttcttcatttgttctccagttgtattcatcctttcccttgttcttggagggcaactagtgtcttgtttctatgtttactgttcccattgaaaccctagagcaacgtttgggtttcagaatcaagttattaaaaaaaagtgtctttccttctcaggagcaaggcggggaggtgagccaggctcacctggggcggctgttcgtgttcgcgctgctgtggagcgcgggggcggcgctggagctggacggacggcgccgcctggagctctggctgcgctctcggcccacagggacgctggagctgccgccgccagcggggcccggggacaccgccttcgactactatgtggcgcccgatggtacatggacgcactggaacacgcgtacccaggaatacctgtatccgtctgataccaccccagagtatggttctattctggtgccaaatgttgacaatgtgaggactgactttctaattcaaaccattgctaaacagggcaaggctgtgctattaattggtgaacaaggaacagccaaaacagtaataattaaaggatttatgtcaaaata

SEQ ID NO: 5758 - DNA, 2081 bp, Homo sapiens
  ENST00000508040
gtgtatgcagaaaggcgactgtcctaggagtatgaccaaccctccttcaatgctaggcttcagccacctcctcctgaaagctgtcctgtcatccccacccctaccccttatcaactccaggctagagtgggagacccttctttttgctccttctctgtagacccataaatgcccctgcatttggagacccataaatctgatgcctctgtggcaactgccatgccatctgtcatatttaaattttcagctcacatcctgccagccaggccatgagcttttttgaggttaccaggtagtgttagtctcttcagtgctgacacatattaggggtttaacaaatgtttgttgattaaaagaagggatccagaggggccacttttcctcttcccagtgggagctactggttggcattaaagcaaagactgaagggagagaaggaagccaagcgggctcttttggatgcgaggcataactacttatttgcaattgtggcttcctgtttggacctgaacaaaaccgaagtggaggatgccattcttgaagggaatcagattgaaagaattgatcaactttttgctgttggaggtctccgacacctcatgttttactatcaagatgtggaggaagcagaaacaggacaacttggctctctaggaggggtaaatcttgtttctggaaagattaaaaaacctaaggtgttcgtgaccgagggaaacgatgtggctcttactggggtatgtgtgttcttcatcaggactgacccttccaaagccatcacccctgacaacatccaccaggaggtgagttttaacatgttagatgcggcagatggaggcctgctcaacagtgtgagacgtttgctgtcggacatcttcattcctgctctcagagccacgagccatggctggggcgagctcgagggccttcaggacgcagctaacattcgccaggagttcttgagctccctggaaggctttgtgaacgtcctgtcgggtgcacaggagagtctgaaggagaaggtgaaccttcgaaagtgtgacatacttgaactgaaaaccctaaaggaacctacggactacttgactctagcaaataaccctgagactttgggaaaaatagaggattgcatgaaagtatggatcaaacagacagaacagcgtctccagccccgtgcaatggctcgtgtttttccccgcgcatttgcaggttcttgctgaaaacaatcagctgctgaaggaagcggatgacgttgggccacgagcggagctggagcactggaaaaaaagactctccaagtttaactaccttttggaacaattgaaaagcccggatgtgaaggctgtgctggcagtgcttgcggcggccaagtcgaaactgctgaagacttggcgggagatggatattcgaatcactgatgcaactaatgaagcaaaggacaatgtgaaatacttgtatacacttgaaaaatgttgtgaccctttgtacagcagtgatcccctatccatgatggatgctattcctacacttataaatgcaattaaaatgatctatagtatctctcattactataatacctctgagaagatcacatctctgtttgtaaaggtgacaaatcagattatatctgcatgtaaagcctatattaccaataatggaaccgcttccatctggaaccagccacaggatgttgttgaagaaaaaatactatctgcgattaaactgaaacaggaataccagctctgctttcacaagacaaaacaaaagcttaaacaaaatccaaatgcaaaacaatttgattttagcgagatgtatatttttggaaaattcgaaacttttcaccgacgccttgccaagataatagacatctttacaaccctcaagacgtattcagtcctgcaagattccacaattgaagggctggaagacatggccactaaataccagggcattgtggcaaccataaagaaaaaggaatacaatttcctagaccagcggaaaatggattttgaccaagattacgaagagttttgcaagcagactaatgaccttcatgtaggttgtataataaaattcctgttgac

SEQ ID NO: 5759 - DNA, 2435 bp, Homo sapiens
  ENST00000476689
gcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgccagtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaatgcagattatcataaagtgcagagcagtggaagtttcattaatacaccacatgagttgcccacttatggagactctgagaaaatgacatatacagaacaggccagcaaaaggcattattgcatgaggctgacgtgctttattcgtctaaacgactatctaattgagaacacaatgcacatcttaacggtaaatgctgttaattcgcttttgaaccatctcactgacaagctaaaacgaacaccttcagcagatgtcattcagaaatggattactgaagagaagcctgaagtccctgataaaaaggggacccttatggtggaaaagcaagaagaagatgaatctctcatccccatgtttctcacagaactaatgttgacagtccagtcactgctctttgagccttctctggaagactttctggatggtattttgggtgcagttaatcactgtcaaaacactgtgttatcagttcctaatctcgtgcctgattcgtattttgatgctttcaccagcccttatattaacaacaaacttgaaggaaaaacctgtggaactgggccaagtttagcagcagtatttgaggatgataagaattttcacacaattatttctcaaataaaggaaaccattcaggccgcatttgaatcagcccgcatctatgcagctacctttgaaaagttccagatattcttcaaggaaaatgaaagtcttgatttacaagctcttaaacttcaggaacctgatattaacttttttagtgaacaactggaaaaatatcacaaacagcacaaggacgcagtagcgctcagacccaccagaaatgtaggattgctgctcattgatactaggcttctaagagaaaaattaattccatcacctttgcgatgcttagaggtgctaaattttatgcttcctcgtcaaagcaagaaaaaagtggatgccattatctttgaggcacaagatgcagagtataaacttgagtttgttccaactactaccacagaatatgttcatagcttattatttcttgatgaaattcaggaacggattgaaagccttgaagatgaggggaatatagtgactcaaatgtacaagcttatggaacaatatcaggtgcccacacctcctgaagactttgctgtttttgcaactatgaagccatccattgttgctgttcggaatgccattgataaatcagtgggtgatagagaatcaagcattaagcaattttgtgtgcatttgggtagtgatcttgaagaattaaacaacgaagtgaatgaagtaaaactgcaagcacaggtaagctaaatcattattttgtaaaaataatctatgcaaagttttactattacatttgtttattaaagtataatcaacagataaaaattgtatatatttacaatatataatgtgatgttttgatatacgtatacattgtgaaattgttaatcaagctaattaatgtgtccatcacgtcacatacatcattttttgtggtgagaataattaagactactcttcaaaccatttagagaacacatttaactgatgtagctttagttttttatagtatcattctaaccaatcaacaatgtctttgagctgctacttaaaaattaatgtttcaaaatctctgtttaagtagtgaatacatttcagactatcacaaagcatatatgtaatattaaaattgaatttagccaattaaattctagtcctaacttgtatttattattttgaagagtgttttaatgacttgctagcacattttacagctattgtcacaattttaaagtttgcttaatacctgggtgatgaaataattcatacaacaaacccccatgacacaagtttacctgtataacaaacctgcacatgtatccctgaacttaaaataaaagct

SEQ ID NO: 5760 - DNA, 551 bp, Homo sapiens
  ENST00000468661
ttgctctctctggagaccctcggcggtggttgctgtattttgacttggagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgccagtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaatgcagagttgtaagttatgagaacatcaataaaaatgactactatactattagccaaagggcagtaacacacatttataatgaagacattgaatttatcgaa

SEQ ID NO: 5761 - DNA, 12666 bp, Homo sapiens
  ENST00000237449
gagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgccagtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaatgcagattcatcggccctatgttgaggtgttctctccctctcctcctaaactgccacatactggtattggaaaaagaggtctctttgggactagatcttcagcttaccctaagtacacttttcacgaccgagaagaagttgttaaagccaacattcgtgatcccttgcaaatcattaaaataatacgtgaaaatgaacatcttggatttctttatatgatccctgcagtgccaagatcatccattgaatatgatacatataatctaaaagttgtaagttatgagaacatcaataaaaatgactactatactattagccaaagggcagtaacacacatttataatgaagacattgaatttatcgaaattgatcgatgggaacaggaatatctgtatcacagagaactcactaagattcccatattttcactgttccggaaatggaaggcttttagtgtatggaggaagaatgtccgctccaagaaaatcactggatgtcaaaaatctctacaaaaaaatttgttcattgttaatcctcatttgcgaccagctcttcttaaaataaatgaattgtgttatcatttgagttttatgggactttgttatattgaaaagtgtcacacctacaccctgcaggaatttaaggccgcacaagtcatacggctagcagaggtgacagaacgcctaggagaatttcgaaatgaggcaaaatatgtagtcaggagggcttgtcgatttgctttgcgtgctgcaggatttgttcctgatgactgtgcatttggaccttttgaggattatcataaagtgcagagcagtggaagtttcattaatacaccacatgagttgcccacttatggagactctgagaaaatgacatatacagaacaggccagcaaaaggcattattgcatgaggctgacgtgctttattcgtctaaacgactatctaattgagaacacaatgcacatcttaacggtaaatgctgttaattcgcttttgaaccatctcactgacaagctaaaacgaacaccttcagcagatgtcattcagaaatggattactgaagagaagcctgaagtccctgataaaaaggggacccttatggtggaaaagcaagaagaagatgaatctctcatccccatgtttctcacagaactaatgttgacagtccagtcactgctctttgagccttctctggaagactttctggatggtattttgggtgcagttaatcactgtcaaaacactgtgttatcagttcctaatctcgtgcctgattcgtattttgatgctttcaccagcccttatattaacaacaaacttgaaggaaaaacctgtggaactgggccaagtttagcagcagtatttgaggatgataagaattttcacacaattatttctcaaataaaggaaaccattcaggccgcatttgaatcagcccgcatctatgcagctacctttgaaaagttccagatattcttcaaggaaaatgaaagtcttgatttacaagctcttaaacttcaggaacctgatattaacttttttagtgaacaactggaaaaatatcacaaacagcacaaggacgcagtagcgctcagacccaccagaaatgtaggattgctgctcattgatactaggcttctaagagaaaaattaattccatcacctttgcgatgcttagaggtgctaaattttatgcttcctcgtcaaagcaagaaaaaagtggatgccattatctttgaggcacaagatgcagagtataaacttgagtttgttccaactactaccacagaatatgttcatagcttattatttcttgatgaaattcaggaacggattgaaagccttgaagatgaggggaatatagtgactcaaatgtacaagcttatggaacaatatcaggtgcccacacctcctgaagactttgctgtttttgcaactatgaagccatccattgttgctgttcggaatgccattgataaatcagtgggtgatagagaatcaagcattaagcaattttgtgtgcatttgggtagtgatcttgaagaattaaacaacgaagtgaatgaagtaaaactgcaagcacaggatccacagattttagatatctctgctgaccaagacaaaataaggctcatattgaataatctgcaatctgttctggctgatcttcagaaacgtgcatttcagtataagtcctatcagaagaattttaaggtagaagtgtccaagtttgaagctttggaagaagtcagtgctgaactgaagctcaaacaattgctctgggattctttctctgaatgggataaactccaacaagaatggttaaagtccaaatttgattgcctggatccagaagtcctaaacggtcaagtttctaaatatgctaaatttgtgactcaactggaaaaaggcttgccacccaacagtgtagtgccccagctcaaatacaaggtggaaaaaatgaaagaaaagcttccagttatcattgacttgaggaacccgactttgaaggcaagacattgggcagctattgaacaaacagttgatgccactctagtggatgctgaaattccattaaccttggagaggctctcccagttgcatgtttttgactttggtcaagaaatccaggacatatctggacaggcttctggagaagctgccttagaagcaattcttaaaaaggtggaggactcttggaaaacaactgaatttgtcattctgcctcaccgtgactccaaagatgtgtttatactgggcggcacagatgacatacaggtccttcttgatgatagcaccatcaatgttgcaactcttgcctcatcacgttaccttggtccactgaaaactcgagtggatgaatggcaaaaacaacttgctttatttaatcaaacactggaagagtggctgacctgccagagaaactggctctacctagaaagtattttcaatgctccagacattcagaggcaattgcctgcagaggccaagatgttccttcaggtggataagtcatggaaagaaatcatgagaaaggtgaatcggctgcctaatgctcttcgagccgctactcagccaggacttctggaaacttttcaaaacaataatgcattacttgaccaaattcagaagtgcctagaggcatacttagaatcaaaaagagttatctttccaaggttttacttcttgtcaaatgatgaacttctggagattttggcccagacacgaaatccacaggccgtgcagccacacttaaggaaatgcttcgactccatttcaaagctcgaatttgctctcatgcctcctgccgaaggaaagattcctggtattgatggagaaccagaaaaggtttatactaatgatattttagcaatgctgtcaccagagggagaaagggttagcttggggaaaggcctcaaggcccgaggcaatgtagaggaatggcttggtaaagtggaagaagccatgttcacatctctgcgtcgcctgtgcaaagctgccatcgctgactatcaggggaaactgaggacagactgggtggttgctggccacccttctcaagttatcctgactgtttctcaaattatgtggtgccgtgatttgactgaatgtctggaaacagaacacagtaatcatatacaggccctgaagaattttgaaaaagtaaattttgagagattaaatgccctagctgcaatagttcaaggcagtcttcctaaattacacagaaacatcctaactgcattgattactattgatgtgcatgcaagagatatagtcactgaacttgttcaatccaaggtggagacagttgaatcttttgactggcagagacaactgcgctattactgggatatagacctggataattgtgtggctagaatggcgctctctcagtacacttatggctatgaatatttgggtgcatgcccaagattggttattactccactcacagatcgctgctatctttgcctcatgggagctttgcagcttgaccttgggggtgcaccagctggtcctgctggcactgggaaaacagagactaccaaagatctggcaaaagctcttgccatccagtgtgtggtctttaactgttcagatggtttggactacaagatgatggggcgcttcttcagtggcttggcacagtcaggggcctggtgctgctttgatgaatttaatcgaattgacatagaagttctgtccgtcatcgcgcagcaactcattaccattaggaacgccaaagcggcaaagctctctagattcatgtttgaggggcgggaaataaagttggtgatgacttgtgcagccttcatcacaatgaatcctggctatgcagggagaactgaattgccagataatttgaaagccctgtttagaccatttgcgatgatggttccaaattatgccttgattgcagaggtaattctatattctgaaggatttgaatccagtaaaatattagcaagaaaaatgactcagatgtataagctttgcagtgagcagctgtctcagcaggatcactacgactttggcatgagagctgtgaagtctgtcctggtcatggctggatctttaaaaagagaaaacccagacctaaatgaagatgtggtgttgataagagctttacaagactccaatttgccaaaatttctaacagatgatgctcttctgttcagtggaatcatatctgacctttttcctggagtccaaattccagaacatgattatggtattttacaatcaacaattgtggatgtcatgaatagacaaaatcttcagcctgagatgtgtatggttagaaaggtgatacagttttatgaaactatgctagtaaggcatggtgttatgttagtcgggccaacaggaggcggcaagaccacagtttaccgaatactagcagaaactttagggaatttacaaaaacttgggatagaaaattccttttaccaagcagttaaaacatatgttctcaaccctaaatcaattaccatgggtgaattatatggagaggttaataacttaaccttggaatggaaagatggtttgatggcactaagtgtccgagcagctgtgaatgatacttcagaagaccataaatggatcatcagtgatgggccagtagatgctctttggattgaaaacatgaatacagtgctggatgataacaagatgctttgcctggctaacagtgagaggattaaactcacacctcaaattcacatgctttttgaggtgcaagatctgcgggttgcctcccctgcaacagtcagtcgatgtggaatggtgtttgtggatcctgaagaactgaaatggatgccttatgttaaaacttggatgaagggtatttctaaaaaactgactgaggaaacccaagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctaaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaaggtatcctccaatgtgatccaggaacaataagagaagaaattcagatatttagactcttttgccatgagtgccaaagggtcttccatgatcgcttgattaataatgaagataagcactatttccatgttattctgacagaaatggccaacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtgtttcaatactttatcagcaaagtgcgtcagaagctgcacattgttctctgcatgagcccagttggggaggcctttcggtcccgatgcaggatgtttccatcccttgtgaattgctgcaccattgactggtttgtgcagtggcccagagaagcacttctttctgtgtcaaagacatttttctcacaagtcgatgctggaaatgaagaactgaaagaaaagcttcccttgatgtgcgtgaacgttcacttgagtgtctccagcatggcagagcgctattacaatgagctgcgcaggcggtactacacgacacccacctcctacctggagcttatcaatctttacctgtctatgctgtctgaaaaaaggaagcagattatttcagcacgagatcgggtgaagaatggtctcaccaagctactagaaacaaacatactagtagataaaatgaaactagatctttcagctttagagcctgtacttttagcaaaatcagaagatgttgaagccctgatggaaaaattggcagtggatcaagaaagtgccgatcaggtccgtaacactgtgcaggaggatgaagcaacagcaaaagtcaaagctgaagaaacccaagcaatagctgatgatgctcaaagagatcttgacgaggcactacctgcactagatgctgccaataaagcactggattccttagataaggcagatatatctgaaatcagagtttttacaaagcccccagatttggtcatgacagtaatggaagcaatctccattcttttgaatgccaagcctgattggccatcagcaaagcaacttcttggtgactctaactttctaaaaaggcttttagaatatgataaggagaacataaagcctcagatattggcaaagcttcaaaagtatattaataatcctgattttgtgcctgaaaaagtggagaaagtgtccaaagcatgtaaatctatgtgcatgtgggtaagagctatggatttgtactctcgagtggtcaaggtcgtcgaaccaaaaagacaaaagctccgcgccgcacaggctgaacttgacattaccatggctaccctgagagaaaagcaagcattactaagacaagtagaagatcaaatacaggccttacaagatgaatatgacaaaggtgtaaatgaaaaagaaagcctggcaaagaccatggccctgacaaaagcacgtctagtacgtgctggaaagctgacagcagcattagaagatgagcaggttcgatgggaagaaagcatacagaagtttgaggaagaaatatcaaatatcactgggaacgtgttcatagcagcagcttgtgtggcctactatggggctttcacagcccagtacaggcagtcacttatagagtgttggatccaggactgtcagtctctggagatcccaatcgatccttccttcagtctcattaacattcttggagatccctacgagatacggcagtggaacactgatgggctgccccgtgacttgatatcaacagaaaatggcattttggttactcaaggcagaagatggcctttgatgattgatccccaagatcaggcaaaccgttggataaggaacaaggaaagcaaaagtggtttaaagatcattaagcttacagatagtaatttcttacgaatactcgagaattcaatccgacttggtttacctgtcttactggaagagcttaaggaaaccttggatccagctctagaacccattcttttgaaacaaatttttatcagtggtggccgactactcatccgtcttggagactcagacattgattatgacaaaaactttaggttctatatgacaaccaaaatgccaaatccccactatctgcctgaggtatgcattaaagttaccattatcaatttcactgtaacaaaatcaggcctggaggatcagttgttaagtgatgtggtgcgacttgaaaaacccaggttggaagaacaaagaattaagctcatcgtgaggatcaacactgataaaaaccagttgaaaactatcgaagagaaaatcctgagaatgctctttacctctgaaggaaatattctggacaatgaagaacttattgacacactccaggattcaaagatcacttctggtgccattaaaaccaggctggaagaagcagagtccactgagcagatgatcaatgtggctcgtgagaagtatcgtccagtggccactcaaggctctgtaatgtactttgtcattgcaagcctctcagaaatagatcctatgtaccagtactcattaaaatactttaaacagttgttcaataccaccattgaaacttctgtaaagacagaaaatctacaacagcgcctggacgtactactagaacaaactctcctaactgcttatgtcaatgtttcaagaggactttttgagcaacataaactcatctacagctttatgctttgtgttgagatgatgcgtcagcaaggaaccctatctgatgctgaatggaatttctttctccgaggttctgcaggattggaaaaggaacgcccacctaagcctgaagctccctggctacctactgctacatggttcgcatgctgtgacttggaagaatcatttccagtttttcacggacttacccaaaatatattgtcacatcctatttccatacgcttaggatcttttgagacttatattaacccacagaaatgggaaggctattctaaaatgaaacacgaagataaacacatgagacaggaaaaggaggcagcacaccaagatccatggagtgcaggattgagttctttccataagctaattcttattaaatgttgtaaagaagaaaaggtggtttttgctcttacagactttgtgatagaaaatcttggaaaacagtttatagagacaccacctgtggacctgcctaccctgtatcaagacatgtcatgcaacactcccctggtattcatcctaagcacaggctcagatcccatgggtgcatttcagaggtttgccagggaaagtggatattcagaacgggtgcagtcaatttcactggggcaaggacaaggacctattgctgaaaaaatggtcaaggatgcaatgaaatcaggaaactgggtatttttgcaaaattgccatcttgctgtttcttggatgttggcaatggaagagctcattaaaaccttcacagatccagatagtgctatcaaggacacttttcgactttttttaagctccatgcctagtaatacatttcctgttacagttcttcaaaattctgtcaaggtgaccaatgagcctccaaaaggcttacgtgcaaatatcagacgagcatttactgaaatgacaccttcgttttttgaagaaaatatacttggaaaaaaatggagacaaataatatttggcatttgtttcttccatgcaattattcaggagagaaagaagtttggcccccttggttggaatatctgctatgaatttaatgacagtgacagggaatgtgctttactgaatctcaaactctattgtaaagaaggaaagattccctgggatgcactaatttacattactggtgaaattacttatggtggtagagtcacagacagctgggaccaaagatgccttcgtactatcttgaaaagatttttttctcctgaaacattagaagaagattataaatactctgaatcaggcatctattttgcacccatggctgacagcctacaagagtttaaggactacattgaaaatctgcctttgatcgatgacccagaaatttttggaatgcatgaaaatgctaatctagtcttccagtacaaagagaccagcactttaatcaacaccatacttgaggttcagccaaggtcatctactggtggagagggaaaaagcaatgacgaaattgttcaagaacttgttgcttctgtccagaccagagttccagaaaaactggaaatggagggtgcttctgagagcctttttgtcaaggatcttcaaggacgtctgaactccttgaccaccgttcttggacaggaagtggaccggtttaacaacctgctgaagttaattcatacttctctggaaacactcaacaaagccatcgctggatttgtggtgatgtctgaagaaatggaaaaagtgtataacagtttcctcaacaaccaggttcccgctctgtggtccaacacagcctacccatccctgaagccactaggatcatgggtcaaagaccttatcctgaggacctcatttgtggatctgtggctcaaaagaggacagcctaagtcctactggatctctggtttcttctttcctcaaggatttctaacaggaactcttcaaaatcatgctcgaaaatacaatttgcctatagatgagctgagtttcaaatacagcgtaattcccacctatcgggatcaagctgcagtgatagaagctgccaagacagtgcaatttggacaagaactgcccatggacatggagttgccctctcctgaggatggtgttcttgttcatgggatgttcatggatgcttctcgatgggatgataaggagatggtgatagaagatgcattgcccggacagatgaatccagtgctgcctgtggtgcattttgaaccacaacaaaactataagccaagcccaacactttaccactgcccactttataaaacaggagcccgggcaggaacactctcaaccacaggacattcaaccaattttgtggtaaccgtcctgttaccctccaagcggtccaaagactactggattgccaagggatcagctttgctctgccagctgagcgaatgaaaaggtgccacctcagccctgaaaaagaaccaggccagagatctttcctaatgggagcaaaaggtttgaataatttatatgtgagcaaaacggtgttaattctgatttgacttaaacgtattgtgacttttatttctcttatgaccttaaaataaagtgtttgagttctttctgttggcaa

SEQ ID NO: 5762 - DNA, 2065 bp, Homo sapiens
  ENST00000494025
aaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgattatcataaagtgcagagcagtggaagtttcattaatacaccacatgagttgcccacttatggagactctgagaaaatgacatatacagaacaggccagcaaaaggcattattgcatgaggctgacgtgctttattcgtctaaacgactatctaattgagaacacaatgcacatcttaacggtaaatgctgttaattcgcttttgaaccatctcactgacaagctaaaacgaacaccttcagcagatgtcattcagaaatggattactgaagagaagcctgaagtccctgataaaaaggggacccttatggtggaaaagcaagaagaagatgaatctctcatccccatgtttctcacagaactaatgttgacagtccagtcactgctctttgagccttctctggaagactttctggatggtattttgggtgcagttaatcactgtcaaaacactgtgttatcagttcctaatctcgtgcctgattcgtattttgatgctttcaccagcccttatattaacaacaaacttgaaggaaaaacctgtggaactgggccaagtttagcagcagtatttgaggatgataagaattttcacacaattatttctcaaataaaggaaaccattcaggccgcatttgaatcagcccgcatctatgcagctacctttgaaaagttccagatattcttcaaggaaaatgaaagtcttgatttacaagctcttaaacttcaggaacctgatattaacttttttagtgaacaactggaaaaatatcacaaacagcacaaggacgcagtagcgctcagacccaccagaaatgtaggattgctgctcattgatactaggcttctaagagaaaaattaattccatcacctttgcgatgcttagaggtgctaaattttatgcttcctcgtcaaagcaagaaaaaagtggatgccattatctttgaggcacaagatgcagagtataaacttgagtttgttccaactactaccacagaatatgttcatagcttattatttcttgatgaaattcaggaacggattgaaagccttgaagatgaggggaatatagtgactcaaatgtacaagcttatggaacaatatcaggtgcccacacctcctgaagactttgctgtttttgcaactatgaagccatccattgttgctgttcggaatgccattgataaatcagtgggtgatagagaatcaagcattaagcaattttgtgtgcatttgggtagtgatcttgaagaattaaacaacgaagtgaatgaagtaaaactgcaagcacaggtaagctaaatcattattttgtaaaaataatctatgcaaagttttactattacatttgtttattaaagtataatcaacagataaaaattgtatatatttacaatatataatgtgatgttttgatatacgtatacattgtgaaattgttaatcaagctaattaatgtgtccatcacgtcacatacatcattttttgtggtgagaataattaagactactcttcaaaccatttagagaacacatttaactgatgtagctttagttttttatagtatcattctaaccaatcaacaatgtctttgagctgctacttaaaaattaatgtttcaaaatctctgtttaagtagtgaatacatttcagactatcacaaagcatatatgtaatattaaaattgaatttagccaattaaattctagtcctaacttgtatttattattttgaagagtgttttaatgacttgctagcacattttacagctattgtcacaattttaaagtttgcttaatacctgggtgatgaaataattcatacaacaaacccc

SEQ ID NO: 5763 - DNA, 1873 bp, Homo sapiens
  ENST00000602588
caagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctaaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaagacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtaggatgtgccagagtagttatgtggctttatcacaaaaacgtttcttcaccttttatttaaccattcattgattgcctgaaggggtccatgaataaaatttttttcaatataa

SEQ ID NO: 5764 - DNA, 12795 bp, Homo sapiens
  ENST00000389394
gcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgccagtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaatgcagattcatcggccctatgttgaggtgttctctccctctcctcctaaactgccacatactggtattggaaaaagaggtctctttgggactagatcttcagcttaccctaagtacacttttcacgaccgagaagaagttgttaaagccaacattcgtgatcccttgcaaatcattaaaataatacgtgaaaatgaacatcttggatttctttatatgatccctgcagtgccaagatcatccattgaatatgatacatataatctaaaagttgtaagttatgagaacatcaataaaaatgactactatactattagccaaagggcagtaacacacatttataatgaagacattgaatttatcgaaattgatcgatgggaacaggaatatctgtatcacagagaactcactaagattcccatattttcactgttccggaaatggaaggcttttagtgtatggaggaagaatgtccgctccaagaaaatcactggatgtcaaaaatctctacaaaaaaatttgttcattgttaatcctcatttgcgaccagctcttcttaaaataaatgaattgtgttatcatttgagttttatgggactttgttatattgaaaagtgtcacacctacaccctgcaggaatttaaggccgcacaagtcatacggctagcagaggtgacagaacgcctaggagaatttcgaaatgaggcaaaatatgtagtcaggagggcttgtcgatttgctttgcgtgctgcaggatttgttcctgatgactgtgcatttggaccttttgaggattatcataaagtgcagagcagtggaagtttcattaatacaccacatgagttgcccacttatggagactctgagaaaatgacatatacagaacaggccagcaaaaggcattattgcatgaggctgacgtgctttattcgtctaaacgactatctaattgagaacacaatgcacatcttaacggtaaatgctgttaattcgcttttgaaccatctcactgacaagctaaaacgaacaccttcagcagatgtcattcagaaatggattactgaagagaagcctgaagtccctgataaaaaggggacccttatggtggaaaagcaagaagaagatgaatctctcatccccatgtttctcacagaactaatgttgacagtccagtcactgctctttgagccttctctggaagactttctggatggtattttgggtgcagttaatcactgtcaaaacactgtgttatcagttcctaatctcgtgcctgattcgtattttgatgctttcaccagcccttatattaacaacaaacttgaaggaaaaacctgtggaactgggccaagtttagcagcagtatttgaggatgataagaattttcacacaattatttctcaaataaaggaaaccattcaggccgcatttgaatcagcccgcatctatgcagctacctttgaaaagttccagatattcttcaaggaaaatgaaagtcttgatttacaagctcttaaacttcaggaacctgatattaacttttttagtgaacaactggaaaaatatcacaaacagcacaaggacgcagtagcgctcagacccaccagaaatgtaggattgctgctcattgatactaggcttctaagagaaaaattaattccatcacctttgcgatgcttagaggtgctaaattttatgcttcctcgtcaaagcaagaaaaaagtggatgccattatctttgaggcacaagatgcagagtataaacttgagtttgttccaactactaccacagaatatgttcatagcttattatttcttgatgaaattcaggaacggattgaaagccttgaagatgaggggaatatagtgactcaaatgtacaagcttatggaacaatatcaggtgcccacacctcctgaagactttgctgtttttgcaactatgaagccatccattgttgctgttcggaatgccattgataaatcagtgggtgatagagaatcaagcattaagcaattttgtgtgcatttgggtagtgatcttgaagaattaaacaacgaagtgaatgaagtaaaactgcaagcacaggatccacagattttagatatctctgctgaccaagacaaaataaggctcatattgaataatctgcaatctgttctggctgatcttcagaaacgtgcatttcagtataagtcctatcagaagaattttaaggtagaagtgtccaagtttgaagctttggaagaagtcagtgctgaactgaagctcaaacaattgctctgggattctttctctgaatgggataaactccaacaagaatggttaaagtccaaatttgattgcctggatccagaagtcctaaacggtcaagtttctaaatatgctaaatttgtgactcaactggaaaaaggcttgccacccaacagtgtagtgccccagctcaaatacaaggtggaaaaaatgaaagaaaagcttccagttatcattgacttgaggaacccgactttgaaggcaagacattgggcagctattgaacaaacagttgatgccactctagtggatgctgaaattccattaaccttggagaggctctcccagttgcatgtttttgactttggtcaagaaatccaggacatatctggacaggcttctggagaagctgccttagaagcaattcttaaaaaggtggaggactcttggaaaacaactgaatttgtcattctgcctcaccgtgactccaaagatgtgtttatactgggcggcacagatgacatacaggtccttcttgatgatagcaccatcaatgttgcaactcttgcctcatcacgttaccttggtccactgaaaactcgagtggatgaatggcaaaaacaacttgctttatttaatcaaacactggaagagtggctgacctgccagagaaactggctctacctagaaagtattttcaatgctccagacattcagaggcaattgcctgcagaggccaagatgttccttcaggtggataagtcatggaaagaaatcatgagaaaggtgaatcggctgcctaatgctcttcgagccgctactcagccaggacttctggaaacttttcaaaacaataatgcattacttgaccaaattcagaagtgcctagaggcatacttagaatcaaaaagagttatctttccaaggttttacttcttgtcaaatgatgaacttctggagattttggcccagacacgaaatccacaggccgtgcagccacacttaaggaaatgcttcgactccatttcaaagctcgaatttgctctcatgcctcctgccgaaggaaagattcctggtattgatggagaaccagaaaaggtttatactaatgatattttagcaatgctgtcaccagagggagaaagggttagcttggggaaaggcctcaaggcccgaggcaatgtagaggaatggcttggtaaagtggaagaagccatgttcacatctctgcgtcgcctgtgcaaagctgccatcgctgactatcaggggaaactgaggacagactgggtggttgctggccacccttctcaagttatcctgactgtttctcaaattatgtggtgccgtgatttgactgaatgtctggaaacagaacacagtaatcatatacaggccctgaagaattttgaaaaagtaaattttgagagattaaatgccctagctgcaatagttcaaggcagtcttcctaaattacacagaaacatcctaactgcattgattactattgatgtgcatgcaagagatatagtcactgaacttgttcaatccaaggtggagacagttgaatcttttgactggcagagacaactgcgctattactgggatatagacctggataattgtgtggctagaatggcgctctctcagtacacttatggctatgaatatttgggtgcatgcccaagattggttattactccactcacagatcgctgctatctttgcctcatgggagctttgcagcttgaccttgggggtgcaccagctggtcctgctggcactgggaaaacagagactaccaaagatctggcaaaagctcttgccatccagtgtgtggtctttaactgttcagatggtttggactacaagatgatggggcgcttcttcagtggcttggcacagtcaggggcctggtgctgctttgatgaatttaatcgaattgacatagaagttctgtccgtcatcgcgcagcaactcattaccattaggaacgccaaagcggcaaagctctctagattcatgtttgaggggcgggaaataaagttggtgatgacttgtgcagccttcatcacaatgaatcctggctatgcagggagaactgaattgccagataatttgaaagccctgtttagaccatttgcgatgatggttccaaattatgccttgattgcagaggtaattctatattctgaaggatttgaatccagtaaaatattagcaagaaaaatgactcagatgtataagctttgcagtgagcagctgtctcagcaggatcactacgactttggcatgagagctgtgaagtctgtcctggtcatggctggatctttaaaaagagaaaacccagacctaaatgaagatgtggtgttgataagagctttacaagactccaatttgccaaaatttctaacagatgatgctcttctgttcagtggaatcatatctgacctttttcctggagtccaaattccagaacatgattatggtattttacaatcaacaattgtggatgtcatgaatagacaaaatcttcagcctgagatgtgtatggttagaaaggtgatacagttttatgaaactatgctagtaaggcatggtgttatgttagtcgggccaacaggaggcggcaagaccacagtttaccgaatactagcagaaactttagggaatttacaaaaacttgggatagaaaattccttttaccaagcagttaaaacatatgttctcaaccctaaatcaattaccatgggtgaattatatggagaggttaataacttaaccttggaatggaaagatggtttgatggcactaagtgtccgagcagctgtgaatgatacttcagaagaccataaatggatcatcagtgatgggccagtagatgctctttggattgaaaacatgaatacagtgctggatgataacaagatgctttgcctggctaacagtgagaggattaaactcacacctcaaattcacatgctttttgaggtgcaagatctgcgggttgcctcccctgcaacagtcagtcgatgtggaatggtgtttgtggatcctgaagaactgaaatggatgccttatgttaaaacttggatgaagggtatttctaaaaaactgactgaggaaacccaagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctaaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaaggtatcctccaatgtgatccaggaacaataagagaagaaattcagatatttagactcttttgccatgagtgccaaagggtcttccatgatcgcttgattaataatgaagataagcactatttccatgttattctgacagaaatggccaacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtgtttcaatactttatcagcaaagtgcgtcagaagctgcacattgttctctgcatgagcccagttggggaggcctttcggtcccgatgcaggatgtttccatcccttgtgaattgctgcaccattgactggtttgtgcagtggcccagagaagcacttctttctgtgtcaaagacatttttctcacaagtcgatgctggaaatgaagaactgaaagaaaagcttcccttgatgtgcgtgaacgttcacttgagtgtctccagcatggcagagcgctattacaatgagctgcgcaggcggtactacacgacacccacctcctacctggagcttatcaatctttacctgtctatgctgtctgaaaaaaggaagcagattatttcagcacgagatcgggtgaagaatggtctcaccaagctactagaaacaaacatactagtagataaaatgaaactagatctttcagctttagagcctgtacttttagcaaaatcagaagatgttgaagccctgatggaaaaattggcagtggatcaagaaagtgccgatcaggtccgtaacactgtgcaggaggatgaagcaacagcaaaagtcaaagctgaagaaacccaagcaatagctgatgatgctcaaagagatcttgacgaggcactacctgcactagatgctgccaataaagcactggattccttagataaggcagatatatctgaaatcagagtttttacaaagcccccagatttggtcatgacagtaatggaagcaatctccattcttttgaatgccaagcctgattggccatcagcaaagcaacttcttggtgactctaactttctaaaaaggcttttagaatatgataaggagaacataaagcctcagatattggcaaagcttcaaaagtatattaataatcctgattttgtgcctgaaaaagtggagaaagtgtccaaagcatgtaaatctatgtgcatgtgggtaagagctatggatttgtactctcgagtggtcaaggtcgtcgaaccaaaaagacaaaagctccgcgccgcacaggctgaacttgacattaccatggctaccctgagagaaaagcaagcattactaagacaagtagaagatcaaatacaggccttacaagatgaatatgacaaaggtgtaaatgaaaaagaaagcctggcaaagaccatggccctgacaaaagcacgtctagtacgtgctggaaagctgacagcagcattagaagatgagcaggttcgatgggaagaaagcatacagaagtttgaggaagaaatatcaaatatcactgggaacgtgttcatagcagcagcttgtgtggcctactatggggctttcacagcccagtacaggcagtcacttatagagtgttggatccaggactgtcagtctctggagatcccaatcgatccttccttcagtctcattaacattcttggagatccctacgagatacggcagtggaacactgatgggctgccccgtgacttgatatcaacagaaaatggcattttggttactcaaggcagaagatggcctttgatgattgatccccaagatcaggcaaaccgttggataaggaacaaggaaagcaaaagtggtttaaagatcattaagcttacagatagtaatttcttacgaatactcgagaattcaatccgacttggtttacctgtcttactggaagagcttaaggaaaccttggatccagctctagaacccattcttttgaaacaaatttttatcagtggtggccgactactcatccgtcttggagactcagacattgattatgacaaaaactttaggttctatatgacaaccaaaatgccaaatccccactatctgcctgaggtatgcattaaagttaccattatcaatttcactgtaacaaaatcaggcctggaggatcagttgttaagtgatgtggtgcgacttgaaaaacccaggttggaagaacaaagaattaagctcatcgtgaggatcaacactgataaaaaccagttgaaaactatcgaagagaaaatcctgagaatgctctttacctctgaaggaaatattctggacaatgaagaacttattgacacactccaggattcaaagatcacttctggtgccattaaaaccaggctggaagaagcagagtccactgagcagatgatcaatgtggctcgtgagaagtatcgtccagtggccactcaaggctctgtaatgtactttgtcattgcaagcctctcagaaatagatcctatgtaccagtactcattaaaatactttaaacagttgttcaataccaccattgaaacttctgtaaagacagaaaatctacaacagcgcctggacgtactactagaacaaactctcctaactgcttatgtcaatgtttcaagaggactttttgagcaacataaactcatctacagctttatgctttgtgttgagatgatgcgtcagcaaggaaccctatctgatgctgaatggaatttctttctccgaggttctgcaggattggaaaaggaacgcccacctaagcctgaagctccctggctacctactgctacatggttcgcatgctgtgacttggaagaatcatttccagtttttcacggacttacccaaaatatattgtcacatcctatttccatacgcttaggatcttttgagacttatattaacccacagaaatgggaaggctattctaaaatgaaacacgaagataaacacatgagacaggaaaaggaggcagcacaccaagatccatggagtgcaggattgagttctttccataagctaattcttattaaatgttgtaaagaagaaaaggtggtttttgctcttacagactttgtgatagaaaatcttggaaaacagtttatagagacaccacctgtggacctgcctaccctgtatcaagacatgtcatgcaacactcccctggtattcatcctaagcacaggctcagatcccatgggtgcatttcagaggtttgccagggaaagtggatattcagaacgggtgcagtcaatttcactggggcaaggacaaggacctattgctgaaaaaatggtcaaggatgcaatgaaatcaggaaactgggtatttttgcaaaattgccatcttgctgtttcttggatgttggcaatggaagagctcattaaaaccttcacagatccagatagtgctatcaaggacacttttcgactttttttaagctccatgcctagtaatacatttcctgttacagttcttcaaaattctgtcaaggtgaccaatgagcctccaaaaggcttacgtgcaaatatcagacgagcatttactgaaatgacaccttcgttttttgaagaaaatatacttggaaaaaaatggagacaaataatatttggcatttgtttcttccatgcaattattcaggagagaaagaagtttggcccccttggttggaatatctgctatgaatttaatgacagtgacagggaatgtgctttactgaatctcaaactctattgtaaagaaggaaagattccctgggatgcactaatttacattactggtgaaattacttatggtggtagagtcacagacagctgggaccaaagatgccttcgtactatcttgaaaagatttttttctcctgaaacattagaagaagattataaatactctgaatcaggcatctattttgcacccatggctgacagcctacaagagtttaaggactacattgaaaatctgcctttgatcgatgacccagaaatttttggaatgcatgaaaatgctaatctagtcttccagtacaaagagaccagcactttaatcaacaccatacttgaggttcagccaaggtcatctactggtggagagggaaaaagcaatgacgaaattgttcaagaacttgttgcttctgtccagaccagagttccagaaaaactggaaatggagggtgcttctgagagcctttttgtcaaggatcttcaaggacgtctgaactccttgaccaccgttcttggacaggaagtggaccggtttaacaacctgctgaagttaattcatacttctctggaaacactcaacaaagccatcgctggatttgtggtgatgtctgaagaaatggaaaaagtgtataacagtttcctcaacaaccaggttcccgctctgtggtccaacacagcctacccatccctgaagccactaggatcatgggtcaaagaccttatcctgaggacctcatttgtggatctgtggctcaaaagaggacagcctaagtcctactggatctctggtttcttctttcctcaaggatttctaacaggaactcttcaaaatcatgctcgaaaatacaatttgcctatagatgagctgagtttcaaatacagcgtaattcccacctatcgggatcaagctgcagtgatagaagctgccaagacagtgcaatttggacaagaactgcccatggacatggagttgccctctcctgaggatggtgttcttgttcatgggatgttcatggatgcttctcgatgggatgataaggagatggtgatagaagatgcattgcccggacagatgaatccagtgctgcctgtggtgcattttgaaccacaacaaaactataagccaagcccaacactttaccactgcccactttataaaacaggagcccgggcaggaacactctcaaccacaggacattcaaccaattttgtggtaaccgtcctgttaccctccaagcggtccaaagactactggattgccaagggatcagctttgctctgccagctgagcgaatgaaaaggtgccacctcagccctgaaaaagaaccaggccagagatctttcctaatgggagcaaaaggtttgaataatttatatgtgagcaaaacggtgttaattctgatttgacttaaacgtattgtgacttttatttctcttatgaccttaaaataaagtgtttgagttctttctgttggcaa

SEQ ID NO: 5765 - DNA, 2381 bp, Homo sapiens
  ENST00000330899
ggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaatataaaagctctgattttgccctgtatgtatgatgacttcagtgtgcaagatgaagtttaatacctgtaaaaactacaaagaagttcccctagcatttctaggccaaaccttgtaattgacttcagctatgtacgtggacaagcttagactgaaatgctaggtatatgtattggcttcagtgtatgacccttcattgttaagctatgaaagtaaaactctgtatttaactggcaatgaggaaaaaaaaattttgtagagaagtgttggtctgtatagttctttatattaagtgggattcattgtaatgcctctgcatttattctgttgcctcagctgttacttgaagatggcgtaatatataatttatcctgtggtatcagtgataaaaatgatacctttctgtaggaggggtttatcataatatgctgcttcttgaaggcttgcacttccagaattgtgtttccttctgctgtgccattcatatatatatacatatatatatataatcttgaccagtcctggtcatttgctcccctccttgtctgtggaccatgataagcccaagtagtgacttcagagctgggtaacagaaattaaagtgaaaagacctttacgtggagaatttgcatgcgtaatataggaaggtgttctttaggtatgttacaggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctccaa

SEQ ID NO: 5766 - DNA, 604 bp, Homo sapiens
  ENST00000495015
gaacgctcggtgagaggcggaggagcggtaactaccccggctgcgcacagctcggcgctccttcccgctccctcacacaccggcctcagcccgcaccggcatgaaagatggccagaagataacattccatggtgaaggagaccaagaaccaggactggagccaggcgatattatcattgtgttagatcagaaggaccatgctgtttttactcgtagagatggggtttcaccatgttggccaggctggtcttgaacttcagaccttaggtgatccaccctcctcagcctcccaaactgctggaattacagatgcgaaccacagtgcctggcctaaccctcactcttacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactg

SEQ ID NO: 5767 - DNA, 505 bp, Homo sapiens
  ENST00000465677
caagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaagctgtaatgtactttaagaatacttgagaacaattggcttactaaaatctgataaaaaagtaaaatttcagccaggtgcaagtagctcatgcctgtaatccccgcattttgagaggctgaggcaggaggatcccttgagccctggagttttgagaacagcctgggcaacatagtgaaaccctgtctctttaaaaaaacaaaaaaaaaaaaaaa

SEQ ID NO: 5768 - DNA, 3245 bp, Homo sapiens
  ENST00000394855
agacggcggccacacccccggggagaggccgggtggggaccgcagggcgcagctctcccagtcccacccttcggcgcagggctccggccaacacagccctccaggccgcctactctccagccagccggctccacggacccacggaagggcaagggggcggcctcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataa

SEQ ID NO: 5769 - DNA, 947 bp, Homo sapiens
  ENST00000489435
agtcccacccttcggcgcagggctccggccaacacagccctccaggccgcctactctccagccagccggctccacggacccacggaagggcaagggggcggcctcggggcggcgggacagttgtcggagggcgccctccaggcccaagccgccttctccggcccccgccatggcccggggcggcagtcagagctggagctccggggaatcagacgggcagccaaaggagcagacgcccgagaagcccagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagggacacggacatctgcaacctgacatcagcttgtactcatattctgggttttcggtgacaagtgacacacagttgatcataagtaccaatcatagactgaaaatgctctgcattttagagacagaagttaaaagcttttccatcctgtttacagaaagtttgctttttatctctaaagaggctcatgacccacctgaataggtgaattgaaggatgaggcattgcaaggaaaggctgctaaccctcccgttcctcctttcacttcttgccattttcttacaaaactttggttgttccgcatgggtcttgagaggtggggccgttatagtagctgatagcagtgtcacttgggccacgtttgaaaccacaccaatcacccatgtagcatttaagacctgtggaaacgacgctggaatcaaaatacctgtctgtgttagttgttccaagctggagaaagctacttcaggacggttggctgaatggcaacagtgatggaatatttatatttagccacatgtgctgaatgtggctgtcacaagtttaaaatgctttcctgtaa

SEQ ID NO: 5770 - DNA, 1308 bp, Homo sapiens
  ENST00000440911
ggaggagccggtggctctagtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaa

SEQ ID NO: 5771 - DNA, 514 bp, Homo sapiens
  ENST00000423642
agtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacat

SEQ ID NO: 5772 - DNA, 1320 bp, Homo sapiens
  ENST00000483802
agtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaa

SEQ ID NO: 5773 - DNA, 2961 bp, Homo sapiens
  ENST00000343789
agtgcggtggagccaggcgtggaaacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataa

SEQ ID NO: 5774 - DNA, 3116 bp, Homo sapiens
  ENST00000394852
ccaggcgtggaagtcggtccggcgcggggcggggggcgggcgggagctacaagcggcggcggcggcggcgaccgtgaccgtgacgcgcgagcgggcggcgggggcgcgggccaggggcgcgggccagggtgccggcaggggcgtccggggcgctctgaccggcctcgcccgccccccccgcagacacaagatggtgaaggagacccagtactatgacatcctgggcgtgaagcccagcgcgtccccggaggagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagag

SEQ ID NO: 5775 - DNA, 866 bp, Homo sapiens
  ENST00000542636
gcgggcgggagctacaagcggcggcggcggcggcgaccgtgaccgtgacgcgcgagcgggcggcgggggcgcgggccaggggcgcgggccagggtgccggcaggggcgtccggggcgctctgaccggcctcgcccgccccccccgcagacacaagatggtgaaggagacccagtactatgacatcctgggcgtgaagcccagcgcgtccccggaggagatcaagaaggcctatcggaagctggcgctcaagtaccacccggacaagaacccggatgagggcgagaaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagc

SEQ ID NO: 5776 - DNA, 1399 bp, Homo sapiens
  ENST00000446172
agtctcctttaaggagagcttgtaggcttctaatttcacatttcagcaagctggctaaagacatgtgggaaagcctgaccctggattcaggtcaaatctcagcactcacaagatttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgca

SEQ ID NO: 5777 - DNA, 2006 bp, Homo sapiens
  ENST00000485075
ggtttgtatccaatgtctggcacgtggttagatgctcacagatgcctgtagttgaatttcattctagtaaactagtgaaatgattcccatgaggaggtgagccagtggtaatgcccagagtcctggctctatctggttagaggttcacccctggcactgtctcatggtatcctagctggtctcgacttcctgtctggtgcagccggattagtgagaaactttccctctctactggcttctctcccttattcttatcgtgtccctaccaccagtcccttaatatgtttgccctgtgtttcccactttaccaaaggagtaggtagacaggcaagtcagattccaggtagaggatgtatagactggctagttcaagggtttgggggcagaatacctctattactttgtatgtttatatggcaggtttgcttaacaaaacaactgaaacttctctaaaaatctctctctctctctcttttaaagtttaaactcatatcccaggcatatgaagtgctttcagatccaaagaaaagggatgtttatgaccaaggcggagagcaggcaattaaagaaggaggctcaggcagccccagcttctcttcacccatggacatctttgacatgttctttggtggtggtggacggatggctagagagagaagaggcaagaatgttgtacaccagttatctgtaactcttgaagatctatataatggagtcacgaagaaattggccctccagaaaaatgtaatttgtgagaaatgtgaaggtgttggtgggaagaagggatcggtggagaagtgcccgctgtgcaaggggcgggggatgcagatccacatccagcagatcgggccgggcatggtacagcagatccagaccgtgtgcatcgagtgcaagggccagggtgagcgcatcaaccccaaggaccgctgcgagagctgcagcggggccaaggtgatccgtgagaagaagattatcgaggtacatgttgaaaaaggtgaggctgcgcagagctggtgctccacacgggctggaaatgctgtctgggtgctaatcgtgagatacacagactagatgtcagggaagtgagctgtatcacaacatgtattgggtgtgccatgaattcctcttgtttcccagtcttctcttcacccttcctggccttatttccattccatgtcacctgccaaagtgttcttgctgaggtttacttccttgagatcacagacagcctctttatgaggttttctaacgctctgaaagtcttacctggccttggtttgggttagttgccatctcctgacattctcaagccattcctctagaatctttcggagtgtcttcctggtcgcttctgatgctcattggccataagggcttgtgtaagtgtttgtggctgcatgttccctttctccacatttccccatgtgctgcatcagattcccccaaatacagcaccttctcctgctattcattttgcctgatgccatcattttaaggcctttttccattttagctgtcctccaagtattccgatgattctgtggctttccaatccagtaaatatatcctagatcagagatgagaccaaaagtaaaagaatcaacagccaaaccgacacaggtgttattaaaggacttactgtttaaacatgcctaaaccctgtgccttgagtgtgcaagctgacttattagaaaaggacagggctggctgacctgtccctatcagtcccaagtcatgcaccctgtgccccgggaagtgggcggtgaccctatgctggtggtgtggcatcacaggccctgggcagggagtgctgtgtaaacctgggatgtagagccgcattcccccactccctgtgcatgctgggcttggccccacattatgccaagggaagcgggacctcttctgtcattggccatcctagccacccctccctgccttgtgcctgcatgaggttgggagacttgatgaataaagaatccctgaaggactctgttccttcttcaaaa

SEQ ID NO: 5778 - DNA, 1134 bp, Homo sapiens
  ENST00000493321
cctagatcagagatgagaccaaaagtaaaagaatcaacagccaaaccgacacaggtgttattaaaggacttactgtttaaacatgcctaaaccctgtgccttgagtgtgcaagctgacttattagaaaaggacagggctggctgacctgtccctatcagtcccaagtcatgcaccctgtgccccgggaagtgggcggtgaccctatgctggtggtgtggcatcacaggccctgggcagggagtgctgtgtaaacctgggatgtagagccgcattcccccactccctgtgcatgctgggcttggccccacattatgccaagggaagcgggacctcttctgtcattggccatcctagccacccctccctgccttgtgcctgcatgaggttgggagacttgatgaataaagaatccctgaaggactctgttccttcttcaaaagctttaaggaagcatggtttgtatgagaaatggctaatcagaaagggatgatgtttcataggtatgaaagatgggcaaaagatactatttcatggagaaggagatcaggagcctgagctggagcctggtgatgtcataattgtgcttgatcagaaggatcatagtgtctttcagagacgaggccatgacttgatcatgaaaatgaaaattcagctttctgaagctctttgtggcttcaagaagacgataaaaacattggacaatcgaattcttgttattacatccaaagcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggc

SEQ ID NO: 5779 - DNA, 2961 bp, Homo sapiens
  ENST00000480425
atttttaaaacctcctctttaaagatttcctcttgaagagacagctcactttctacatagtcccgtatggaagtggactgctgaagaaattagtgtttccattcccctccaccgtctcccccattttttccgaacatttctttctgtctttgtccattttcatcgctgagctgaagagcatgctttatcagaaacccttttgtccctttccttttccatgcttagagggaagtttctgacttgggagaacgccttagagttcttggggtctgaactcctctgatgccttccaaagtcacgtagctgtaagacccagcgggtgccagccgggagggtgactccagctcagcagcatgtatggaagtgcattgtgaccatgaaggagtctgccagtggccaagccacctagtgagctccctaccaaggaacctgggtgtcacctgcaggtggccaagagccagtttttatgccaggcaggggactggttggactctattgaggcttcttcctgtctgtggggagcactcctgtccccctcgtggtagggatacctgtcaccccacaaagaggcagggtgacaggtgttggccccattttaggcagacttgggtgtcatgacttctagttcacttgttttaaacctacctgtgatggcagctgcaccatgctgccctcttgacacactgctggagcccagagcacaggccagagtctcagcctgagccccttccccaggcagtacctgacaaggatacctgggattggggccagctttccagtcagatgccacgtttcctttgcccactgccacggggcactagggcctgccgcaggctctcccatgagggagaacgacctctgcaggcccctctgccttcctccttcctaattgaccctttctctggcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaatactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccagtgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataa

SEQ ID NO: 5780 - DNA, 2264 bp, Homo sapiens
  ENST00000254322
agagtccgggactggtcggcggcggagccgggggacggcgacagcgggtcggcgggccgcaggagggggtcatgggtaaagactactaccagacgttgggcctggcccgcggcgcgtcggacgaggagatcaagcgggcctaccgccgccaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctc

SEQ ID NO: 5781 - DNA, 1287 bp, Homo sapiens
  ENST00000396969
aagcgacggttaggccagacgcgggggcggggtaagaagttgagtgacaggcaaggcagcatccacatgacaggcggcgccgaaggggtaaattctgagatcctgcccctgagctttcatgagctgttgaaccatctggaattcacaggcctgtcatgagagacacgatgagaagtccttaaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccct

SEQ ID NO: 5782 - DNA, 882 bp, Homo sapiens
  ENST00000598235
cgacggggacggcgcggcggagcccgctgcggacccgggctcacctgggctcggccgccggggtccgcggggcggcgcctccggctcagctgcggggcgaggggttgtgaatgcaggagccgaccccgttcgtgggcttgggggctgggttgggataattcccgggaagtgatgacctggccccggcagggcacgcaggaggcagcggccgcccaggtccggagagcggggccgcctcggagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaacattccagctgatatcgtctttgttttaaaggacaagccccacaatatctttaagagagatggctctgatgtcatttatcctgccaggatcagcctccgggaggctctgtgtggctgcacagtgaacgtccccactctggacggcaggacgatacccgtcg

SEQ ID NO: 5783 - DNA, 569 bp, Homo sapiens
  ENST00000595139
gttcctgtgcccgttgatgattcaggctggcttctgggcttgatctggagctgactttttgtgcaaggatggtggcagtgaatgctaatgtgcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaaaatcactttccccaaggaaggagaccagacctccaacaa

SEQ ID NO: 5784 - DNA, 593 bp, Homo sapiens
  ENST00000596853
gtacaccgggaacagcaggagagggctaggggctggggtcgcgggctgcggagtctggttggcgaggagatcctgcccctgagctttcatgagctgttgaaccatctggaattcacaggcctgtcatgagagacacgatgagaagtccttaaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaaccaa

SEQ ID NO: 5785 - DNA, 601 bp, Homo sapiens
  ENST00000595992
gttaggccagacgcgggggcggggtaagaagttgagtgacaggcaaggcagcatccacatgacaggcggcgccgaagggatcctgcccctgagctttcatgagctgttgaaccatctggaattcacaggcctgtcatgagagacacgatgagaagtccttaaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaagtgaagaaggggtggaaagaaggaacc

SEQ ID NO: 5786 - DNA, 995 bp, Homo sapiens
  ENST00000594099
aaagaaggaaaaagaatgggtcagcagtggccacacggcccctgtttctcgcttcttacctcgtaatgcttcatggctccctcccacggcggctactgctccgcggctgctgctgcctaactgcgcggcacagcacaggctccctacagcgctcgcaaccgcagcgatagactaaacgcggctctgcgtccgccccgcccctccaggccgcgcgcgccccgtcggccaatcagggcacgaggcgcccacgttcgcccctgctccttggggccggtccgaaccaagactaggactagcaccaggggattgaccaatcaacttgcgagaccaatcgaagggggcggaacgcctgtaggaggggctaaagagaaggggcttgaccatccaccaatccaaaggaggtctctgccccgcgcgtccctttgccacgccccctgatggcgtcgctgtggaaaccaagatcctgcccctgagctttcatgagctgttgaaccatctggaattcacaggcctgtcatgagagacacgatgagaagtccttaaaggtagatcactgattcacaggggagcaggcggaggcaagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaaccccgacggaaagagcattcgaaacgaagacaaaatattgaccatcgaag

SEQ ID NO: 5787 - DNA, 573 bp, Homo sapiens
  ENST00000601533
aagcgacggttaggccagacgcgggggcggggtaagaagttgagtgacaggcaaggcagcatccacatgacaggcggcgccgaagggatcctgcccctgagctttcatgagctgttgaaccatctggaattcacaggcctgtcatgagagacacgatgagaagtccttaaaggtagatcactgattcacaggggagcaggcggaggcaagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtaccaagaagatgaaaatctcccacaagcggctaaac

SEQ ID NO: 5788 - DNA, 567 bp, Homo sapiens
  ENST00000598692
gtggaaaccaaggtaagcgacggttaggccagacgcgggggcggggtaagaagttgagtgacaggcaaggcagcatccacatgacaggcggcgccgaaggggtaaattctgagatcctgcccctgagctttcatgagctgttgaaccatctggaattcacaggcctgtcatgagagacacgatgagaagtccttaaaggtagatcactgattcacaggggagcaggcggaggcaagggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtacca

SEQ ID NO: 5789 - DNA, 573 bp, Homo sapiens
  ENST00000596075
agcatccacatgacaggcggcgccgaagggatcctgcccctgagctttcatgagctgttgaaccatctggaattcacaggcctgtcatgagagacacgatgagaagtccttaaaggcgctgcgctaccacccggacaagaacaaggagcccggcgccgaggagaagttcaaggagatcgctgaggcctacgacgtgctcagcgacccgcgcaagcgcgagatcttcgaccgctacggggaggaaggcctaaaggggagtggccccagtggcggtagcggcggtggtgccaatggtacctctttcagctacacattccatggagaccctcatgccatgtttgctgagttcttcggtggcagaaatccctttgacaccttttttgggcagcggaacggggaggaaggcatggacattgatgacccattctctggcttccctatgggcatgggtggcttcaccaacgtgaactttggccgctcccgctctgcccaagagcccgcccgaaagaagcaagatcccccagtcacccacgaccttcgagtctcccttgaagagatctacagcggctgtac

SEQ ID NO: 5790 - DNA, 488 bp, Homo sapiens
  ENST00000601087
gcagcatccacatgacaggcggcgccgaaggggtaaattctgagatcctgcccctgagctttcatgagctgttgaaccatctggaattcacaggcctgtcatgagagacacgatgagaagtccttaaaggtagatcactgattcacaggggagcaggcggaggcaagggtgagtcagtgcttggaactcagtcatccagatttggctctggaaacttctgaagctgtagcctttggggatccctgactgcgagtacaggaagccaacgctatgtggtcttctggaaactcattatctttttcactggtgctatctgggaaaaacagatgaaaacctgaaggtgttctgtatgtgtgctttcaaaagcaaggatctggccggacgcagtggctcaggcctgtaatcccagcactttgggaggccgaggcaggaggatcacctgaggtcaggagtttgagaccagcttggccaacatggcgaaaccatct

SEQ ID NO: 5791 - DNA, 949 bp, Homo sapiens
  ENST00000487931
gcgctggtgtgggttagggctgagaaagaacgacaggaacagagacgtcgcgaggattaagtttaagacttcgcgagaacagaatttcttttggcacctcctctccgcgcgttcttgggggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatatttt

SEQ ID NO: 5792 - DNA, 737 bp, Homo sapiens
  ENST00000477671
taagtttaagacttcgcgagaacagaatttcttttggcacctcctctccgcgcgttcttggggctggagtgcagtggcacgatcttggctcactgaaacctcagcctcccaggttcaagagattctcccacctcagcctctggagtagctgggatcacagagtctctgttgcccaggctggaatgcaatggtgcgatctcagtcactacaacctctgcctcccgggttcaagcgattatcctgcttcagcctcccgagtagctggaattacagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaat

SEQ ID NO: 5793 - DNA, 906 bp, Homo sapiens
  ENST00000484662
gcgcgttcttggggtgaggctgggtaattgttcctgcagggtggtgggtgatagtggccagttgactgcgactgtgtttgggtggtgggaagcctgaagaaaaggttgtttcttaccggtcgctgcctcagggaggtagtgcggtagaattttccgctatgggtcattctcggtgtccgcggggaagggcgtgacaacgacgggcgtgacggcgaagcaacagtgtctcgagagcgctgccgcccggagggcgccaggagaagtgcgtccgagacgccgcgcggtgatgctcctgaaaacgtctgcccggcgtagcgggaacccagcatgattttcaggggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgag

SEQ ID NO: 5794 - DNA, 686 bp, Homo sapiens
  ENST00000426517
gttaaggtctcttaagttaagaacagcattgtttcttgaccaaaatagattttgtagcttcttaggcgtagtttctcccaccccatcctgtgggtactcaaatgtaagatcatattctgaattgtcatcacaggactagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatat

SEQ ID NO: 5795 - DNA, 2988 bp, Homo sapiens
  ENST00000370763
agagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggctttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaa

SEQ ID NO: 5796 - DNA, 673 bp, Homo sapiens
  ENST00000476396
gggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaagg

SEQ ID NO: 5797 - DNA, 5228 bp, Homo sapiens
  ENST00000541010
cgagggaggagactcccgtcagtgacttcattgagtaggttcttggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggcatgtttaagcgcacagtgctctcctgcccacccccagcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcggtaagtccctccggagaagggcactcacacccatacccagtcaaaccctccacgcggccatcccctccattgccttcctgcttcctccaactcatcctcatcccctctgtgacatacaggaacccccctccggcctcacccacatatttgaatgaattgcaccccttatcattccttttctcaaacccttcaggtatccattttccacagacatttcctccattatttcaactctccacattcctccctttcaacccatcattaacccattttccacctcagccatttccatctgtcactcatccccctccatcagtacctcattttctgtatcagccatctcccctccctgtacctcaacagtccccctcgccattttctccccatttttccttcctgcctctaccttaacatcctcctcattcttctccatcaaaggcagtgccatgccatggggctcctttgtcattccaacacgtggcctgtgggtaggggggaagggaaggagggaggaaagcagaaagagaaaaaggaggcagatcctgaaagagcttgccctgtgtctgcggaggcaagagatgtatgggcctagagcagctagcaggtgggtaccagggaggaagctggccgggtgtggaggtaatgcagggacaccaaaaggaggtgggtggttggtgagccgttccactggccctctgcctggaagctgctctcgttctctaggggcaccctcttggtgtgctagggttctttcccagtcccaggggaaagaaggtgtgggttgaggcagaaatggcagaccacccccccccgctccctctcagacggcttttgctgccatttccgaaaacggttgcccccccccccaacgaggtgctctttcttctctgcctctcccaaccccaccccccaccccatctcccccacagacgtgacatgctggtggggggcaatgggggagtacccgcctttgtggagccttttcttcgtcagagaaaggtgactcccagaaccatgagtcaacccagccacctgcagcagggcctgtgggggcagcagtgagggccattgtccctgcccacctagggccttgggcgcctcccccttacccggttacaggcctcactcctggaaggacaccctgtacacctccctgctgtgaagcagtcagaggcagaaaggcaggtctcagctgtggctgccagcctaggacattgctagaaagactctggttctcctggctttggcaggggttggccaagtctcagaagggctgagaatggcttctggccatcccccagagagctctagctacaggaaagtcccccttcccctgatatccaccacagacacaccgatagagggagactggaatggaagaattcgggttgtacgtttctcttataacaaatgctcctgcacccaccttaaaagggactcagaggaatatgggtctgatgatgggccggatcctaaaccacagggtggactgggggcgtagggtgaggctaggagaggtattaaggaaatggtggttggttagtgcccaattgtctcctaacagctggggttgaaaaagtcctgtccccaggatgcttttgttcactcacactggtgcttaggcggcacagccctcacagttttgtgtgtagacgctggcaaatgagtaaagggaactgttgccctggttgggggaaggatagtgtcgccccccctgctaatgagggagttggaaacagcagtttccaaaggctgtgagtcaccctgtgatctgagtcacacgtgaggcttagcatcgtcagaggggtgggggcggggaggcctggggtctccgatggcagacaggactccagacacccattccctgactcagtctggctggccaggacagctggcggaagacccaggcctgttcccggtcctgggccactgccccagctgccctcagcctgggcaccatgcctgaggcgtggcgtaggagaccacgatgctcaggtgacctcacccgttacactgaccttcgccagctcctgtgtgtgggtcgctcagtccatggtgccacctcgctcagcagggcctctcaggggtcctcagtctggcccaaggaccagggcctcagcctagccccaagagtgggccacaaccttcagcttcctgctgggaaaacccaggaggtgaggacggaatcacagaattctagaatgtcagagccagaagagatcatctagtccaaacctttcattttacagatggggggacgcaggcccacagaacaggcatgacctgctgaaggttacccagggagtcatttagggattgcaagatcatcaggaacagggctggggcagaagagaaggcatcaagtcttggccctgggtttctttcagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 5798 - DNA, 2818 bp, Homo sapiens
  ENST00000454002
cattgagtaggttcttggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggcatgtttaagcgcacagtgctctcctgcccacccccagcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatggca

SEQ ID NO: 5799 - DNA, 3068 bp, Homo sapiens
  ENST00000545841
ggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatggcatctgagcaggagcaacaaacctgggatgggggtggctgaggagggccactgtcatcctccctcccgggctctggtcacctttgagaagcccaagcaggccctcagtataagctgaagctgacctctgccttcctcgaagcctcctgggatttctaaaacttatacttcaaacacagcacagacagaaagtaccactcagctattagaagaaacatctatttgggaaggaaaaatatccctgctcatgagagacagagaccattgtcttcagatgtgctagcatgaaaacagattttctcttcttgtctaaattttctctgagtcagacaaattttccttctaggagaaaatttttttctaggagggggtggagaactttttttttttttttttttttttgacacggagtcttgctctgtcgcccaggctggagtgcagtgatgcgatcttggttcactgcagcctct

SEQ ID NO: 5800 - DNA, 683 bp, Homo sapiens
  ENST00000539059
aggaggcagatcctgaaagagcttgccctgtgtctgcggaggcaagagatgtatgggcctagagcagctagcagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagat

SEQ ID NO: 5801 - DNA, 615 bp, Homo sapiens
  ENST00000443266
cacctcgctcagcagggcctctcaggggtcctcagtctggcccaaggaccagggcctcagcctagccccaagagtgggccacaaccttcagcttcctgctgggaaaacccaggagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgag

SEQ ID NO: 5802 - DNA, 851 bp, Homo sapiens
  ENST00000537321
gtcccgggtggaggcggcggagccggagccgggggagggggcagcggctgtctcacggaccacggcggcgcccgcagctcctcaccggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcac

SEQ ID NO: 5803 - DNA, 852 bp, Homo sapiens
  ENST00000469798
cgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatcc

SEQ ID NO: 5804 - DNA, 484 bp, Homo sapiens
  ENST00000458263
gtcccgggtggaggcggcggagccggagccgggggagggggcagcggctgtctcacggaccacggcggcgcccgcagctcctcaccggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccaccca

SEQ ID NO: 5805 - DNA, 2391 bp, Homo sapiens
  ENST00000312316
gggggcgggctcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatgg

SEQ ID NO: 5806 - DNA, 2589 bp, Homo sapiens
  ENST00000453597
ctgagctgagtgacaggaagacggttcaatgggcggcgcggaggcggagccgtgggggcgggctcccggtcccgctatcggcggccggcgggcaggcgactcctgtcccgggtggaggcggcggagccggagccgggggagggggcagcggctgtctcacggaccacggcggcgcccgcagctcctcaccgcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatgg

SEQ ID NO: 5807 - DNA, 1022 bp, Homo sapiens
  ENST00000441561
atactaatgtggtaatcagtgaactatttgcttccgtttccttcagtcactattccctggcgaagtctccacgcgctcccgttcgccggggaacttagggtatccgggcttccctaaattgacaagcgggggccggcgccttcgcccgccttcgctggccgccgcttggtttgttcttcttctccttcggggacttctccgcccgcgcccgcgcccgcgccccagctttcgtcccgctgtgcggagatgccacccagctccaccgcaggaccgcggagcgagaggcggcagacgcgctccgggggccgccggtcaagaggaagatgaagggcgcgacgacttcgcggtttccagaatgggctccttctggcccaacaataagtgccatttggaatcttctcggccttctctgtgccttccgcgcgtctgggctccccggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtgg

SEQ ID NO: 5808 - DNA, 1609 bp, Homo sapiens
  ENST00000429029
agttgacgccgccgtgccgccgccgcgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcctgagtgggatctgga

SEQ ID NO: 5809 - DNA, 2527 bp, Homo sapiens
  ENST00000262177
agttgacgccgccgtgccgccgccgcgtgacgcatttcctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaataca

SEQ ID NO: 5810 - DNA, 699 bp, Homo sapiens
  ENST00000486083
ctgtttgttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggtgttctagatgacttccattttcaggctctcaggatttacacactggggaagctgctgctccatggctgctatatgtatgtagtcactgagcagcctgctgacgggtttgaggaagtggccggtgaggacttggagcctagtgaggagttagtagagctgcccagggtggaggaggccacagagg

SEQ ID NO: 5811 - DNA, 852 bp, Homo sapiens
  ENST00000417758
gttgttggagaaaggagagaaaggaaagcgcgaggagccgccgccaccaccagcgcagcagtcctggagctgtgaggagattcgggccgtcaccctgcctcccctgcgtcccgccaccggccgcttctgtcctcggtgagggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaa

SEQ ID NO: 5812 - DNA, 7992 bp, Homo sapiens
  ENST00000459889
ggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggtgtgcaaagggaggcagccgtggagcaggcgcagagtgagacttctctgggtgccagaggacagcgaggacacaaaccgcgcctgggctgctgtgttctgacctgagcgggcgtgggcggtcgggcggggcgggaggaggtagcctcgctctgctcctctcccgctcgcggcgccccacgccacggtggctccgggccccccaccgttaaaacggggtccgcgtgtcctgtacgcagcgtgttgctccgcaaaggatgacagagctgccacggcagtgcgaggtgctgcttttaccgtagacgtgccttttcgtagctttcagcgtagagcttgaggcctgtggcttaggccgggtggtctcgtgctggtggggtctgcgtttgcccctgcccctccgtcagcttcaccttctcgtgccttcttctgcgctgggtgcagaacaaaagaccccctcaagtcaagcctccttgtgaagcgtagtctgcccgcccaccccccgtggggttcttggccgccctgccctcctcccacctgttagggagccggatagtctctgaagtgagtgccccggagaagttctgggtcaccctgaggacgtgctgtgcatgtaggcttggccctgactgcgtcctaaagcccagggtccatgtagtgtgaatcgtgcgtcagttggaagtatttgtgcctcttctggttcttatcaccgcacgcggtgaggtgaccccagccgctcatgtcgtgcaggaagacatggatggttgatccctgggtttgggggaccgaagcggatgtcgtgaggttacttctgtggacttgggccgaacagcactgtctaagcaggacatgaaaagaagggggaagcgtctctccttttcccttcatggaactttccattgaaaaattagccccttccagtccttctcggatgaagcacagttgccggttacgcttccgaggaggacggaaggtgcacccccagccgtgagagcctcaggatgtgccgcctgtgggtgggcacggcagcccctccagccggccgcccacctgccgtgctgcgctcacctttgctgtgtgagtctgtgctgtgtcactgagtgacagacagaggcagttgcaggctgcatgcacccagaaagaactccccctgcactaagcgggcatgggggaggctccccagggtccctgcactgagcggggtgggggaggctccccacggttccctgcactgagcggggtgggggagactccccacggttccctgcactgagcgggcgtggggaaggttcccaggatccctgcactgagcggggtgggggagactccccacggttccctgcactgagcgggcgtggggaaggttcccaggatccctgcactgagcgggcgtggggaaggttcccaggatccctgcactgagcgggcgtaggggaggctccccaggatccctgcactgagcgggcgttggggaggctccccagggtctgttgtgcgctcctggtactggagggtctgatggccgtagggagggtgcactgtttgtcgatgggtctttgcaaggtgcaggatagagcagggttgtagctgtagtgtccctgaaccactggggttaggaggccaccggaagcctggcctgctaggggccttgtgatttcgcaggccccgagaacgtggtgtgcaggtgcgggccgcctgggggagccatgtttaaagtgcggtgaggctcctggaacggcacccaccgcaggcccgaggccacacctgtatgtcagaactgggcgggtcttctcctcccaggccttcagcgcctgtggctatggctgtgggcgggactgatacgggcaggcaggcgctgttctccccacgtattctcggcttccccgccatacaccgtttctgagtggggagaactggttgactgctgaatcccaacacaaatccttagagcaaagaggccagtgatggcttttgtttctgcccggatcctctttgtggatcttccgttttgcggcttttcctctcatttgtttcctttttttaatcgcttcatgagatcttgaagataccaaagtaaccatcaaagatttaaagacgtgatttttatacaaatatataacgaacacgtcagagacttttacttaagttcttactgagagatgacaaagctgactcaaaggatgagtcaagaaaccgctgcagagttggagacagaactggagtgaaattgcaaagcagggtggttttggtctctgcagaggccatttgcgactcactcaccaactccggtgtcagggtgctggtgggtgacagggaagaggttgagcaagcctccgcccctgcaggctcgctcattatacaatgagcacctgcaccaccaaatccgaacaactgtacatgcttacagagaagggcacgtgctagtgtgggagtgacaaagtcacacgggtgcagaccccttagctccagcctgctgggtgttctgacgaatggactttgtagcgataacacaggctcctgagtcaggatactggtttgctgcatttctgcgtcactgaaggtctcgctttccccgaagccccttgtcacagaaaacccatgactcttggccaggcctctgggtgcctggaagatcccactatcatctttttgtgggatttgcatgtcctggtcaaggttcctgtaaaaggaatacagtgaggagaccggccacccgacagtattgatggcccccactttggcctccagccgtctgacccgtccctgaatcgagcaggtcctgtcggagctcccaggagtgagcgagcttccactcacagggtcacagccaggtgtgcagcccccaggcctgggcggttctagggcatgattttttttaggctggaaatgagctctcacttgagatgcacccctcaaaatactgaacgtactgcttctgtgagaatttcccctccttgtgtctggtgtgattgacaacgggtgcagccagtggaagcaggaatgtcggggagcgcggggtgcagggggtgccctgtcacagtcagcggggagcgcctgtccctgctgcgtggtgtggggttcccgtggctggcatttgctgctgtgtggagtcctcaaacccagcgctcgccctgcctgcgttcagaggacagaggcaccaccgggaacccaccggatcctcactcaggctttggaaaggccgagtgatgttttgtgtttgtgaattccacacatactgtaggagtatcaagaacacgtaactgttaaaaaaggaaaagtaaaattactgaacaggaaagaaagaataaagcaggtcctttgtttttttggctgaggaaagcagcctgccctggaacgctgtagaatgtctccctttttgtgaagcacagcatggagctctcggaactgaagatgggaatctaaccctgccctcagctttcaacagctcgaagtttgtctttttaatgaaactaatttgtgtatttatacttaagggttttcaagtccttaaacttgataagaaaacttaagtcgttttctatcaggacaagtttttaagtagtcactggtgggagagcgtgcctctgtggactgtgcccaaggctggcggtcccacgaagtcccagagcccgcgagccggtgcccaaggccatgtctgtgatttgcaggaggttcaggtgacaggaaggcctgctctgtttttctcacttcaattttggacttttttttttttttttttttttttgagacagtctcgctctgtcgcccaggctggagtgcagtggcgtgatctcggctcactgcaacctctgcctcaagggttccagcgattttcctgcctcacctccccagtggccggaactacaggtgcttgccaccacttctggctcatttttgtatttttagtagagatgtggtttctccatgttggactggctgctctcgaactcctgacctcaggtgatccccccgcttcagcctcccaaagtgctgggattacaggcgggagccaccgcgcccggcaatagtggaggcttgaagaacaccggaaagtggtttccttgtaccggacccgcccctcccccaccatcccggcagccccagggcgggtgagggcgactgcagtgtggtcacctcaggctttccgtccctagctcataaaggcccagtggcagcagttgctttaaaggagctccgttactccctttgttctggggtcttggtaaagtttgctttgctgaagcggaggaaccgcaggcggtgctgacccccccaccccgcccccatcccacggggtcccttgggtcccggggcacgaggctcctctgagggacacggcctccaagagctggctctgccctggccgccctccacagtcacggcggctccccgcatgctcctcgggacggagatctcctggcttcctcccgcttcctttcctctgcgttttccgcagagccgcctccctgctttggaagcaggtactcagcggcctctgcagccgccaacggcacacaggcctctctctgttcgttctttctttccgtaaccgtagcttgaggcacatttcctaaatatgcagcatggaacgcttggcggttctgaacgcgcatctcgtgctgctcctgtagggcggttaggacgcgctcctctggcgaggaaggtggcagcctccactgtgcacgggtcacaggcgagtgtggtgtggtgtggttgtgggtggggtgtggactggatctgcaggcttgtccctctctcgtggagagctgtcggggtccaggcagtgctcagtggtgagagccacagcacatttgaaagtccacatgtgtttgccccactgtggtccaggacatgtgtgagccacactcagtggacttgcacctgtgacatgttggtcagcgtggcggccgtcagctgggtgtggaatgcatctgattggagcctggcacccggcctaccatgattgtgattctctggggcgagtcctgagtgtgggcagggcctcaggcccccaagagggctgtgagcaggcaccttcctgtgaggcacgatgccaccatgtgaagttgtgtgggtctttggagagttctggcaggttgagggcctgtgcgtgtgggacccaggcctgccctgcctgctgccggccatgttccctctgcccagtcatgttgacaattgtggccaaattcaacatcgggcctgtttcctgcacccacgttggcacacactgagttcaagacagtttctgcagaaatgaatccagaggtgtttatttctggcacgttggatcagacgttcagagggtgggcgtctttctccatgcacttcagctggatcagtcagtgtcagccattgactttagcaacagggaaatgaaagactttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattg

SEQ ID NO: 5813 - DNA, 551 bp, Homo sapiens
  ENST00000488001
agagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgttgtttttgtcttttgacttattgaaagggaaacacattgtatgtttacctccttcatt

SEQ ID NO: 5814 - DNA, 1159 bp, Homo sapiens
  ENST00000443280
agagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatg

SEQ ID NO: 5815 - DNA, 614 bp, Homo sapiens
  ENST00000441291
gccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttggacagggcagtgtttgggttgaagtcctgtgttctgatcggtgattctcatggtgaccaagcgaggaagaaggcccgctcttccaacaccatggcttctcttctggggcacacgagaagacccttttgaggacttctttggga

SEQ ID NO: 5816 - DNA, 566 bp, Homo sapiens
  ENST00000437030
accaccagcgcagcagtcctggagctgtgaggagattcgggccgtcaccctgcctcccctgcgtcccgccaccggccgcttctgtcctcgaaacgggagtggcttgcggagcaggaatgccgcagccgtgccgccaagttcggagggagaagaagcaggtgggggaccgcaaagccctgtttctagaactccggacggattgttcagaagtttgtggaagagcaggctgcctttctcactcagaatgtttgtctgctttgctttgcgttaaagaatctgcaccgtagttgatgcaactgaagtttatataagaagtttacattaactcttacctaaggaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgaca

SEQ ID NO: 5817 - DNA, 506 bp, Homo sapiens
  ENST00000412557
tttttctaaggctcccgcactcgcgtctgaaaccagaaacgggagtggcttgcggagcaggaatgccgcagccgtgccgccaagttcggagggagaagaagcaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatc

SEQ ID NO: 5818 - DNA, 590 bp, Homo sapiens
  ENST00000453383
actcgcgtctgaaaccagaaacgggagtggcttgcggagcaggaatgccgcagccgtgccgccaagttcggagggagaagaagcaggtgggggaccgcaaagccctgtttctagaactccggacggattgttcagaagtttgtggaagagcaggctgcctttctcactcagaatgtttgtctgctttgctttgcgttaaagaatctgcaccgtagttgatgcaactgaagtttatataagaagtttacattaactcttacctaaggaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatg

SEQ ID NO: 5819 - DNA, 398 bp, Homo sapiens
  ENST00000439402
ttcactatgttgttcaggctggtctcgaactcctgacctcaggtgatccacccgcctcggcttcgcaaagtgctggattacaggtgtgagcccgcgcgtccggctgtcactttaaagagtattataagagggcacttcataacttgggcaggtatttttagtcatcctgaacgtgtcgctgtggactgggtgtcaccgcgggaccgcacagacaccttactgtcgtctgctgtaaaggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaa

SEQ ID NO: 5820 - DNA, 1005 bp, Homo sapiens
  ENST00000634080
atggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcaggtgtgcaaagggaggcagccgtggagcaggcgcagagtgagacttctctgggtgccagaggacagcgaggacacaaaccgcgcctgggctgctgtgttctgacctga

SEQ ID NO: 5821 - DNA, 900 bp, Homo sapiens
  ENST00000468928
gtcttgggcacagtttgggtcaggcacttttgttagctgtctcctgttagagtcttctcaaccactgggacttcctgagtggtgcactgggtgacctgagaggtcaggattaaacatgtactcctgtagttgtttttgtcttttgacttattgaaagggaaacacattgtatgtttacctccttcattgcctggagcttgggtgaagaaactgaacaccacctgcaactcgaggagggaaagagaagagtagttgtgtctacagataatacaggggagaaacgtggagctcctgcctgccgcaggcacgaagaagcataatcactctcatatctggggaccgggagactggcgtgctcatcgtttaagtgcatttgctgtaatcactgctgccatcagcagaaacagagctcaagaaagaaccatgtttacatccgtccttcatcaaccctcacaggacagggcagtgtttgggttgaagtcctgtgttctgatcggtgattctcatggtgaccaagcgaggaagaaggcccgctcttccaacaccatggcttctcttctggggcacacgaggctctcaggatttacacactggggaagctgctgctccatggctgctatatgtatgtagtcactgagcagcctgctgacgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggtta

SEQ ID NO: 5822 - DNA, 694 bp, Homo sapiens
  ENST00000465908
gagcttgggtgaagaaactgaacaccacctgcaactcgaggagggaaagagaagagtagttgtgtctacagataatacaggggagaaacgtggagctcctgcctgccgcaggcacgaagaagcataatcactctcatatctgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcacccgggccctgggaccccctcgcgtccgcagcag

SEQ ID NO: 5823 - DNA, 5173 bp, Homo sapiens
  ENST00000487480
ggcattgatggtcctcgttcctgtaactggtcctgtggacacagccactttcttccactgcccattctgtggtcttgtggccttcagcaggcacctcactggttgtggttctttctggtgaggtaaagtaaaaaagaagttggtagcacatttgattaacacgtgtcttaagatttatttctaaggtataaaagtatgatcagttgtttataaatccaaaagtaataatacatgctgggtttaagatttgaaaatgggaatgaggtgagaggaggaggaggtcttgcccctccaccccagttggagccccacaggaacgttgtagcacgtgctgtatagttgtgatgcccgcggtcggagccccacgggagcattgtagcacgcgctgtatggttgtgcgttgtagcgtgcgctgtatagttgtgatgcccacaggcttccttgcatttctctccagctctgctagccacgaacacttcaagtctgcacttcacatgcttgcttgcctgtgcatggttacgcacgctcagcaacttagttccacgttttgggatgagttgagttccctgacgtagaattgctgggttgagggttttttataataaaaatattggttttattttgggggctgaaggttttaaaagcttaatacatacttctagattgcttttcaaaacgacagaaaccagcacatgataagtagctcttacttgaaataaggacttgtctgatctcaagtggcaacttttaactggtctttaaatattataaattttgaaattattttaatgtttcttagcactgtttctgttacaaatgagacttcatttttagggtaatttgtgattttaatatttgaaattatacgagttaaaattcagtgaatacctgaattgtgaaaaattatatttaagctacaaaatgtcagtagagaaataaacaagataaagatttttttcatacaagaaaatggaacggaaaagcattggccttctcataacatagtactcagccagcttttgaggtagcttctgtagatgatgatataattatgaatgtcattgtcttaatttagcttagaatgcaaaccagttaaaatcacttggttagtactgttaccactgagacacgggttcaagatgcatgtaaaagctcagtgccttgtggacaacttctaagggtttagttgccatggatttaaagaaattgtgactaaaccaatgttttagcattgataaatgggaaattgcggaaggatgtaaacgtagagtttaactctacaacttggcttagggactcaggtatggacagtgagaataacttggtttagggactcagatatggacagtgagactggccacatgagtgcctttctcactgtcacactcttacccaggttggagtgcagtggctgtcgacaggtgtgatcatagctccctgcagccttgaattcctgggctcaagcagtcctgcctcagcctcccaaggaggtgggactaaagatggtgtgccaccacacctggctaatttttaaatttattgtagagaaggggtcttgctatgttgcccaggttggtcttgaacccctgacctccagggatctctcctgccttggcctcctcaggagctggaactacagatatatgctaatgtcttcaatttatggaaatgcagaaatgccttttttttttttttttttttttttgagatggactcatgttctgctgcccaggctggagtgctgtggtgtgatcttagctcactgtatcctccacctccggggttcaagcaattttcgtgcctcagcctcctgggtggctgagactacagatgcccaccaccactcctggctaacttttttgtatttttagtagagacagggttttaccatgttggccaggctggtctcaaactcctgacctcaagtgatctgcccgcctcggcctcccaaagtactgggattatagctgtgagccactgcaccctcccggaaatgctttttaacggtcacctcctaggggagatgaagagagttaccgcataatcagttttaactgtatttgtaatgtttgtttctttacctgggaggatatgttgtagatacgtgagatagaatacctaagtgacacaatggtgtgcaggctatggctgcaaagtagaaagtttctaaatagcatgcttggatttttatttgaattggatgaagtttttgtgtcctagagaaattcacaaaatgttcctagtttcagataaaaggttatgatttaacatctttgcttttgttctttcttgtctttgaatagaacagtgggggacggtaaggtctgtttgcaaagtacctatgaccatcttacattatttttatgggtggggggcattgactgtggaatgtgggcagtaacttgcacagtcagtaaccgtttgagtaacttcttgttggcatccccattctggcactcctcctctaggtctccacctcacacgctggtttgtgggcggaggggcaggttggtgcgtggggtgtccgggcactggctgtgcatgccttcttcctcttctgtctcttggccaccttttccaaaaagtcaccagtgaccaattctcccagtgtttctttgggactcaatgccttgggcttggcattgggtaaagccaactggccagtttcattctgacgagctctatagtagtccggtgtggacctctgccctccctgctctgcggaagcttcctcagcctttgcttctcactatttactatttgcgggtcctgggggtacccagcgtctcagggttttggctgcccacctgtacgtcggtcctttcaaactgtggtcagagtcaacctcaggtgctgcttttctctagtcactgcattttttttttttagtagagacaaagtcttgctgtgttgtccagcctggattcaaactcctgagctcaaggaatcctcccactcagcctccagagtagctggatcaagtcactcttgttcataacctcagttgcttcatgaatctcgatttctgcttgatttcagtgcttgctgttgtatccttgtgtgctgcagtatttattgttaacatttgtgactcaaatgtatccactccctgctttggttgctctggcctgcaagtaggccgtactaattctgtagttggtcctagcttgcctttgtctttaccttgcatgcgtttatgtcttaatgcacctattaggattccttgcttttatcacaggtttcccatttttctgaaaaaattacagtaattattaacgcagaacccaggtaaattaaaaaggtttgtatgctttatgaatttttagtaagtactcattgattgataacagcaacagaggaaaacaaaacggtcagttccgatcttgatttccaggagcactttgtgtttccacttggcagcgtgatgcttcctcatgtcggtgattttctgttgagacatcttcaagcatcatcttacgtctgcttgttaacatttgttcagatttgatttcagctaatccttaaaagttttttgagacatcaaacttagaataaaaggaatttcctttgccgagattcatcaggtatttacacttagcttacatggccacaccattcctcgtgtgtgtgtgtgtgtgtgtgtgtgtgtgtgggcgcgcgcatgttagggtaatccatttttctgtttgtttctgaattgctttggagaaggcaactcagactccaaggaatacaacagctgccgtgtgaagcttttctcacttttccagtggtcgtagcaggaacagcgtcttgacctcacatcagtgacgtgaaaagagctgagtttgaagtgcatattggtcctccataaagaatgtgtgtatgtgctgtttttttaattaagtctggtaatttatttgatacaatgtattgtagttttagttgaattaaactagttagtaaaactgttggtgaggtagtgtttcagttactctgtagataagctcttttgttaaaacctcttaagttttttgttcctgaatatgttacaaacatctattttctcttactgtagctatcacatgaggaaaaaaacttgaaaaaaagacttcatagtgtgtgtttatgtttgattttagaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtaaggagcagctgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcctgagtggga

SEQ ID NO: 5824 - DNA, 664 bp, Homo sapiens
  ENST00000486247
attgctttggagaaggcaactcagactccaaggaatacaacagctgccgtgtgaagcttttctcacttttccagtggtcgtagcaggaacagcgtcttgacctcacatcagtgacgtgaaaagagctgagtttgaagtgcatattggtcctccataaagaatgtgtaagacccttttgaggacttctttgggaatcgaaggggtccccgaggaagcagaagccgagggacggggtcgtttttctctgcgttcagtggatttccgtcttttggaagtggattttcttcttttgatacaggtattaaatccctaggtttaatctctgttatcttaacagcagttagtacttataaaatcataatactcttttagttagagtgctttaaaatatgtgtatacctttcgtagaatagcattgtggatttgccagctttttttggtatacaggtctgcgcttaacctacattttctcctaatcttcctaagaatgtcgtgcttggaaatcttctcctcttaatataataatcaaggccagaatgtaatgaaattcttagttaaaaaggggcaacatatgttctgcatcagtaggtggaaagtaacgcagttggaaaatctcactaaccttcatgctgtctaacctcctttgtagttaaaacaaaagtgc

SEQ ID NO: 5825 - DNA, 4992 bp, Homo sapiens
  ENST00000264711
gtctccctcccccggctccccacgctcccaaccgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaagaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaccgg

SEQ ID NO: 5826 - DNA, 1378 bp, Homo sapiens
  ENST00000380809
cgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgagatgaggaaactgagacgcagagaggttaagtgacttgcccaagatcacaaaactagttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagatacatcttggatagaactaatggataaattagtctgtttaaaaaaaaaaagctaacaagaagagaataattacagtattctataaaccttttatatatccatagttgatttatgtgaaaatggcgggaaacgccctaccaccaatagcagtgctagtttcaccaaagaacaagcagatgccattcgcagaattcgaaatagtaaagacagttgggacatgctgggagtcaaacctggggcctcaagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctca

SEQ ID NO: 5827 - DNA, 547 bp, Homo sapiens
  ENST00000494239
gtcactcttccggagatggtgtctggggtggcctctaagccttgaatgtacccccaaaagaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagaccttttatatatccatagttgatttatgtgaaaatggcgggaaa

SEQ ID NO: 5828 - DNA, 561 bp, Homo sapiens
  ENST00000468467
actcttccggagatggtgtctggggtggcctctaagccttgaatgtacccccaaaagagtaagaaggcctgggtccccatgaggggccgtcggcctagataccttgcccgcgttctagggggccgtccgggaccgggagatggaggatgaaagtttagttcccccagccgggcctgggagccggcggaacgttatgggagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgagatgaggaaactgagacgcagagaggttaagtgacttgcccaagatcacaaaactagttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttg

SEQ ID NO: 5829 - DNA, 463 bp, Homo sapiens
  ENST00000468750
gtcactcttccggagatggtgtctggggtggcctctaagccttgaatgtacccccaaaagagtaagaaggcctgggtccccatgaggggccgtcggcctagataccttgcccgcgttctagggggccgtccgggaccgggagatggaggatgaaagtttagttcccccagccgggcctgggagccggcggaacgttatgggagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaag

SEQ ID NO: 5830 - DNA, 485 bp, Homo sapiens
  ENST00000492985
cgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggtaagaaagcctttttgacaaaacctatatccagtattgttggtggtttggggagagatccagaattatatgaaacaaccaatattgatatcatgtgtaaaattgcataattttagcttgatcgtggcttgccttcagagccttgagttaatagacaactgttgatcttttaggttatcctgttaaatagtggtaggaaatttcattgccaatatttcaaacatttcaataagacattttgactttcagaggacttttgctttttacctcatactttagcctaaaatgtg

SEQ ID NO: 5831 - DNA, 4831 bp, Homo sapiens
  ENST00000534855
gtctccctcccccggctccccacgctcccaaccgcccgcgcctgctgccaggcagcggcggggatggcgagcagcggaggcgaggcggtgacgagagcagcggctccgccattggacgaggaggcctgagggacgggccagcggtgcacaagaagagaccgaggcgggtggccccgagagagccagggccatggaggccaacatgccgaagcggaaggagcccggcaggtctctccgcatcaaagtcatctccatgggcaacgccgaagtggggaaaagctgtattataaagcgatactgtgagaaaagattcgtgtctaaatacctggcaacaattggaattgactatggagtcacaaaggtacacgtcagagacagagaaatcaaagttaacatctttgatatggctggacatcccttcttctatgaggttcgaaatgagttttacaaggacacacagggtgtgatactggtctatgatgttgggcagaaagactcctttgacgcccttgatgcgtggctggcagaaatgaagcaagagcttggacctcatggaaacatggaaaatattatatttgtagtttgtgccaacaagattgattgtaccaaacatcgctgtgtagatgaaagtgaaggacgtctttgggctgaaagcaaagggttcctgtactttgaaacttcagcacaaactggagaaggcattaatgagatgttccagggatgaagtcaataaagcgtatcggaaacttgctgtgcttcttcaccctgacaaatgtgtagcacctggcagtgaagatgccttcaaagcagttgtgaatgctcggacagccctcctgaaaaacatcaagtagaaagtacagaaaaaagccacatgtgggactcaaatgcaaacagactttccctagaggtgaaataaccaacgtggagttttccttcccagaatctcactgctcttttcattcatgtgttgtcatttgtatatcagtaattcaggtacccatttcatagacattttactgagaaatgacctgcatttgtatgaagtgaactgagcgtcacaccctgtacttcatttcatatttctagataattctgaatttttttctcattcgtcagctctgtaattatagtatcacttagacatttcacttggggaaatccacaaggttcctggaggagggaagagaggacaagaggaccctttcactttttcttttttacggaattcatcatcagagaagaaaataacaaaaatggaagcaaacaacatcagaacccctgtaagtttggtgtgaccttacagacaagttgctgcttttacaatgagttccttaggtggtattttaacccatcgatctataatgatgactcttggcagccctttgggagtttgtaaaatgaggtgatacagttctgaattgagcattcctttatgatattcactctgttcctcttctgcagccaccagtgggagagacaagccagtcctaagagaaaaggtggtggcagccacaaattctaggtacactggctgctgcctatcctgtccctggatctgaggcctttcccttgccatagaaatggttgctggtagcagtagagagcactgtgcacctgggaatgaggaatcaggccccaagacagaagtacttggaggagccagctgcagtagtatccgcctgtagtcccagctactcaggaggctgagacaggaggattgcttaagcccaggagctcaagtcccacctgggcaacatagtaagatcttgtctcttaaagaaaaaaaaaaaaggtacttagaggtcgcacttaaagattatgcacatcagcagaggaaaggccagccaagcttggggcaagcttgatgcagtaggagagactccttatgaggcttagcccttgtcttactgccagcctttgccacaggcaggtgagaaaggcagggccactcctcagcaaagttggcctcttctacacttcctcaccagtgttgtttcttccttttttcccctcttccccttcccgtcttgtgttttttctgaaccccacatctgccatcatttctctcctctagagtccctggcttctggccactgcctcctccctcttctaagccttggcctgaatctggttgatcagaggcaagtgtggatcctttgggtggcagtcaggggagatctcagggcctctgttgggaggaatctctgtaattcctgcttgggctccaaatttctgaagagtaatatttttaaactatagcttacaaaatacattctctgaccacagtctcctccttgatatacaagggatggatgaagttcatgtattaggactggcactccttacggtgcttatagaactagtctcaccacttgactcattacgtcgtcattcttgttacatcactcatacttttagctgcaaccacactaattcacatttttatatactttcaattagctgtactaattggggcttgaaagtatataaaatcttcctgtcctgtgaattttaaaaagctatcccatatcgattgccaaagagcatctaccttacctcctaagaagaaaagccactttcttccaatccaagcccactgcagccttgtggattttccacacagcagcttttcactgtatgcctgtacttgggctgcactgagcttgtcttcaggaaaccagagcgttgctttatcatcgcacttttcatcttggtaatatcaaaacaactttttaaatgaactgattgatatatgttatttcttgcgaggttttcctctggcctttaactggcttctgaggctacagaactccaacccagagttcttcgggacctaaattttgcttaaggaaggcctttatcatgctgaaagcactcagacatgtctgtcctcacagcagaatgtagaagtcatatgaatgagggatcgtgcacggtagcgtcagcccgaattgacacgacaactctgaatgtgtggccctctatgaaagctggtgccagttttcatcactgttattaaatactagattgggaacctcattcagccgtattgcacagatgagcaattacagcagagaaaattcattagtgctcccactcatatccttatgtgtgagttggtgaaatttagcctgagcttgattcttaggtcttgagactcagtttccaacaccttcattattaatgttaagaatggccatataccacttcatttacgtaaaaggaataaaataagcaagttaagcttcagggtcctagaatttttctgatttctataatccttcagcagaatattaagaaataaagcatgatctgcaatggaaaggtttttttggcactaacttcatgcagaatttcacagacatctatgcattaatttaaattcttggtgcaaatgtgtgctttgtagttcaaccttattaaaaattcttcagccagttaggatttcaaaatacattagtgagagtaacagctagcagaataattacaatggctaaaacgtttttatagagaatcttgtttttcaaaaaagaataaaaagtttgaatagctattattaaagaaaagccatgtcttcaacatctgagtcaccaagaagtaacactttttaaacttgttagaaatccctggaggcatttcaaattcatcttctaacctacctaagcactttaaaatacagcctccttctgttcctctgttccccttcatgcctccttttgaattgatatctcagctgtcaatatttctttgacttcagcattgttattttatttctctatatcaatgtgtccttagttttcttagcctgttaatttaaaaatccagacttgggggtcattgtgttgctacccaagagaaaatgctacagttttatagattgcacatcattctttaaggcatacttttacctcaggaaacttactctagtatgttctcatatattgaattctcaactaagtaactatttctttatacctataaactagtacctaattcactgttagttaaatgagctatagataaggcagctaaatttctgaaagatagccagagtaagtaagcagccactgcaagctctgaatcagttttttaaaaaaaagaaaaaaaaaaaaaaggagctgtgccccattgaacaatgacaacatcacaaggggaagggagggattttgccaaaagttagaaaggtggagctgtaagccatgtgcttgttgcctttgacagtgacagtgcgcgtcttacaactaattccactaggcatgggaatgtcacctcctttgccactgtaccccatcaagcttactctgaatcaaaggttttgtaaaacttttgaaaatgaacttagctgcaaaatatagctaaccactttccattgcaagctttgcaaagtgaagagaggttcgtacttctcataattggtatttagcacaattgtaagatacagttttactgtttgtacatcgtttttttccattaaacttttctagagaagacaaaagcttacactggtgacatggataagtgagatggtgtctaacgagcagtgcaatattaggcggtgcaatagaggccctgttggcaagatgagttttgctggagagctggacagtgttggttagcttcctgcattgattgcccctgggcgttcttcccccttaactgtgaaagcagagtctataaatgaactctttgctcttacaaggtaatttacatattttctttctgttgaaataactgaaaatgttaaatctaccagtttatgtcttgtaaacagagtgtcatatgtatttaagttgtgtatttttataaagtaaagccaagtatcaaacaccgg

SEQ ID NO: 5832 - DNA, 2022 bp, Homo sapiens
  ENST00000457167
acgggtaaagtggcgccgcctacgcaccggcacagcccctgggctcccgccccggcgcggagaccaccgtggacatccgggggcgggaggccgctctggccccaagcggagcctctctctggtagacgagcccgagggagcccttctgggcgcggcgccgcggagctgctctatgctccaaccggaagtgctcttcaccgccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaagagaataaaatgttttgacccttcctggc

SEQ ID NO: 5833 - DNA, 449 bp, Homo sapiens
  ENST00000587727
gacaagaatgcctctgaggacgagatcaagaaagcttatcggaaacgggccttgatgcaccatccagattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaagagaataaaa

SEQ ID NO: 5834 - DNA, 1774 bp, Homo sapiens
  ENST00000426588
gcttccgcctggcgtaggagctgaggcatggccttgttctccagctgagaggacgatcgtccttataggagaggccgagtctccgagggcaatttcagaggtctggtgcgagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttatt

SEQ ID NO: 5835 - DNA, 1719 bp, Homo sapiens
  ENST00000588814
aagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagcttcattaaaactttcctatgtctgattttccggtgcagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcagggg

SEQ ID NO: 5836 - DNA, 1468 bp, Homo sapiens
  ENST00000316603
aagatggcggctgccgcggagtgcgatgtggtaatggcggcgaccgagccggagctgctcgacgaccaagaggcgaagagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagtt

SEQ ID NO: 5837 - DNA, 562 bp, Homo sapiens
  ENST00000585693
agaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtggtgagttggctggggcagcctgggatgaatttgacagctgtagaatgttagaattttttccaaagatgctccagagggagagtctatttgggccaaatctgatccctggtccaaacagtaatagacatggagtcaaacaaatgcagtcaaatgtggcaggttcacagtgtgcagtgagctctgaggaggcgagcactagcaagggaaggcttggaagtgcagaaaagcatggccccatgggtcatgcctgtaatcccagc

SEQ ID NO: 5838 - DNA, 579 bp, Homo sapiens
  ENST00000586335
gaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtggtgggattgttccagccctagactatctttatagacctccagcggaggagattgcacaagctccctcagtctcccatgcctgtgtctaacgcccctcacgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctg

SEQ ID NO: 5839 - DNA, 1762 bp, Homo sapiens
  ENST00000590197
ttttttttttttttttttttaagcaagcccccaacaccatagaaaattcttgatttgctcggaggataattggatgaaggattattttcttctttgtttatgtgcaagaaatgaaaataaggaattgctttgatcagacaacttcttatctttgtggtagaaacagaactgcccttcttggagtggctctgcctctgagatcactacaggggagacagcatgccctgttcagctggctgaatatttggcaacaatctcctgaagcagctggaattgacaagaagtactggagattagctcgggccaaacccttacatctggcctgactactgctgcagtctgcctcaacttacccctaaagctggggagatgccacccacccacatctttgctacacatgccatcatgagctagagttcaccctttctccttaaagccctatttacttttctacttcaactttaaaacaaaattaaaatgtgaggatatccctgaattttaaaaagcatgaagtaaaaatgcaaattagtatagtttgtttaatacattacatatagacctaaagaaagttcatcagggttaatcatttgtcacatcattctatacccagggctatcagctatcaattttccttttttttttttttttaattcaggatccagctctgtcacccaggctggagtgcagtatcaaagtatcatttctcttacttcaaattattacattttattctgtacattgattctgaactcctaatataatatttatgtcctgtatttgcaggccattggtttttttaaagtcataaatcaaaatgatgccagaaaatcaaagatgcccaagatgttgggcttctcttttgccagccacattggtagcactctcctgccctggcctccaagctggtggggatctgtgatgtttgtgaaaatgggcttatgccaggcgcagtggctcacgcctataatcccagcactttgggaggccgaggcgggcagatcggttcaggtcaggagatcgagaccagcctggccaacatggtgaaaccccatctctactaaaaatacaaaaaattagccaggtgtggtggcacatgcctgtaatcccagctactcaggaggctgaggcaggagaatcacttgaaacctgggaggcggaggttgcagtgagcagagatcgtgccattacactccagcctgggctacagagtgagactctgtgtcaaaaaaaaaaaagaaagaaaatgggcttgtgtggtagcaggtaagaaattgaatctctgttgtacagcagctagctgtactgcatgatcacttcccattccccagctgacagtggctgtctctggaactcctaccacagtcttcaattggtaggccagccctggtgccagtgattttatctgggcatggaaaatgccacttgcttctgtggaagagacacttaaaagatctggcagtcggccgggtgcggtggctcacgcctataatcccaacactctgggaggtcaaggcaggcggatcacgaggtcaggagatggagaccatcctggctaacacggtgaaaccctgtctctactaaaaaaaaaaataaaaaattagctgggcgaggtggcgggcgcctgtagtcccagctactctggaggctgaggcaggagaatggcgtgaacccaggaggcggagcttgcagtgatccgagatcacaccactgcactgcagtctgggcaacagagcgagactccatctcaaaaaaaaaaaaaaaa

SEQ ID NO: 5840 - DNA, 441 bp, Homo sapiens
  ENST00000590847
tgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtggtgggattgttccagccctagactatctttatagacctccagcggaggagattgcacaagctccctcagtctcccatgcctgtgtctaacgcccctcacggtcagtaagtttcctctgatgcctgacccaaattccttttgttaaaaagtttaaatccatttcctttggagattttattttgtgttgtacacttatgctctaccctggcacagtgcttgacacataggtgctcactgaataaatgttttgttgaatga

SEQ ID NO: 5841 - DNA, 1058 bp, Homo sapiens
  ENST00000589810
gcttccgcctggcgtaggagctgaggcatggccttgttctccagctgagaggacgatcgtccttataggagaggccgagtctccgagggcaatttcagaggtctggtgcgagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaaggaaactagatgatgcaatagaagactgcacaaatgcagtgaagcttgatgacacttacataaaagcctacttgagaagagctcagtggtgggattgttccagccc

SEQ ID NO: 5842 - DNA, 782 bp, Homo sapiens
  ENST00000588641
cggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactct

SEQ ID NO: 5843 - DNA, 832 bp, Homo sapiens
  ENST00000590348
agtggtcgctgtggtttcagctccctccacactgggataggcagagtatgagcattggcacatgctgttttcctggaacaaacagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagc

SEQ ID NO: 5844 - DNA, 431 bp, Homo sapiens
  ENST00000591153
agaattatgatcctggcaggggaaacagatgaacttggaagaaacaaaagatcttctttgcctgcagctgtccctagtcatggggaggttggggggtgggaagtgaagcactgacgatccccatgattagcagaaccagctctgcataaaacggggtccttgtgaaggcaacagggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaagg

SEQ ID NO: 5845 - DNA, 586 bp, Homo sapiens
  ENST00000589576
cttcctctcccgcttccgcctggcgtaggagctgaggcatggccttgttctccagctgagaggacgatcgtccttataggagaggccgagtctccgagggcaatttcagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaa

SEQ ID NO: 5846 - DNA, 544 bp, Homo sapiens
  ENST00000590774
ctttcttaagttaagcaccaaggaagagggcaactgcttgggcgctgttggcactccgaagcagccgcagtggttcgagattgccagtcggactagccaagggagctgctgaggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctaga

SEQ ID NO: 5847 - DNA, 620 bp, Homo sapiens
  ENST00000589586
gcctggcgtaggagctgaggcatggccttgttctccagctgagaggacgatcgtccttataggagaggccgagtctccgagggcaatttcagaggtctggtgcgagtgacaaatgcatgagccacttttcaggaggtgaaattattaaaactcttgaggatgtgacctatttcacattgagaaataagttgccctgaatggagtaaccatttttcctggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaag

SEQ ID NO: 5848 - DNA, 686 bp, Homo sapiens
  ENST00000585866
cggtaagatggcggctgccgcggagtgcgatgtggtaatggcggcgaccgagccggagctgctcgacgaccaagaggcgaagagtcccacgcctttgacatctcatccttcagtccctttgctgtaaaggcaacttgaacaagcttcagccctttctcagacttccagggcaggacttgaatggatttgacactggaattgttcctgatgcagccttgttcagttcttgctgctgccatgctggattccaaagatccactctttcctcgactggtctcgcaggggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaag

SEQ ID NO: 5849 - DNA, 678 bp, Homo sapiens
  ENST00000589773
gtcgctgtggtttcagctccctccacactgggataggcagagtatgagcattggcacatgctgttttcctggaacaaacagtcccacgcctttgacatctcatccttcagtccctttgctgtaaaggcaacttgaacaagcttcagccctttctcagacttccagggcaggacttgaatggatttgacactggaattgttcctgatgcagccttgttcagttcttgctgctgccatgctggattccaaagatccactctttcctcgactggtctcgcaggggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttc

SEQ ID NO: 5850 - DNA, 543 bp, Homo sapiens
  ENST00000590886
attgaagtttgtattttaatggttttgaaaagctgagtactgggcacttgcttttttgttcttcgggactttagaagtttggagaacaatagtcagcagttgcctagttgctttgtggcctgatgcagagtccctctgagagcccatttctcccttactgcactagtctttggtcccctttctccagcactgagtgatgtggaagttactcagaggtctttccagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggc

SEQ ID NO: 5851 - DNA, 566 bp, Homo sapiens
  ENST00000591787
accatcccaatgctagtcagaggaaacggatgtctccatgtctactactggatgtcccacgcctttgacatctcatccttcagtccctttgctgtaaaggcaacttgaacaagcttcagccctttctcagacttccagggcaggacttgaatggatttgacactggaattgttcctgatgcagccttgttcagttcttgctgctgccatgctggattccaaagatccactctttcctcgactggtctcgcaggggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgct

SEQ ID NO: 5852 - DNA, 541 bp, Homo sapiens
  ENST00000589547
acatcgcccccgacccccgcgttctcttgttaacttctgtgcattgttgcctgtctgcactttccgtctccaaaacctttgctctcctcaccccgttttcccttgtaattataccccagcgatcactagtctgggttcgaagtgattgtgtgtctccataattgacctggttgcccccggttatcccagaagtcaaagatgacagagaaaaaaaggaagagcgaggggcttatctcgtgttctctacgtcagactcctcttcccctgtccttcctgggtgatctttatccttcccagcactgttctttcttaagttaagcaccaaggaagagggcaactgcttgggcgctgttggcactccgaagcagccgcagtggttcgagattgccagtcggactagccaagggagctgctgatgacaaatgcatgagccacttttcaggaggtgaaattattaaaactcttgaggatgtgacctatttcacattgagaaataagttgccctgaatggagtaaccatttttcctggaagcagagactt

SEQ ID NO: 5853 - DNA, 1956 bp, Homo sapiens
  ENST00000587380
tgtaaattaaacatgacaacatgcattattcctgtagttcaaatagtgacagaaaaaaattaattaaaaaaagaaaaaagactgggcgtggtggctcacacctgtaatcccagcactttgggaggccaaggcgggtggattacctgaggtcaggagttcgaaaccagcctgactaatacggtgaaaccccatctactaaaaatacaaaaattagccaggtggggtgatgctgtaatcccagctagtcaggaggctgaggcagaggttgtggtgaggggagatcatgccattgcactccagcctgggcaacaagagcaaaactccgtctcaaaaaaaaaaaaatcaattaaaaaaagaaaaaaatgcattcttatcagacttttatgtttctcatatatagcactgttttcgacagacttaaacatagttatttattatataccacttttttgcacaaatcaaaaggaaaattggctgggtgcagtggctcacacttgtaatcccatcattttgggaggctgaggtgggcggatcacgaggtcaggagtttgagaccagcctggccaacatggtgaaaccccatctctactaaaaatagaaaaaatagctgggcgtagtggtgggcacctgtaatcccagctactcgggagtctgaggcaggagagtcgcttgaacccgggaggcggaggttgcagtgagccaaggtcacaccattgcactccagcctgggcgacatggtgagactccatttcaaaaaaaaaaaaggaaaataagtgaaataaacaaaaaaatcagtttaactttttgccatatcagacatccttagaagaataaacattggccgggcgcggtggcttatgcctataatcccagcactttgggaggctaaagcaggctgatcacctgaggtcgggagtttgagaccagcctgaccaacatggagaaaccccatctctactaaaaatagaaaaaaaaaattagccaggcatggcggtgcatgcctgtagccccaccgacttggaggctgaggcaggagaatcacttgaatccggtaggcggaggttgcggtgagccgagatcgtgccattgcactccaacctgggcgacaagagtgaaactctgtctcaaaaaaaagaataaacattaggctctgttagtatgaaaaagccttgtttatgtatgatttttccagtgctgaaaatgggatggagatttagaagctttggagggaggtggttttatgtttttcatgtgtcctggattcctcttgtgtggccatagcagagggcagtgataggggcatcccttacaaatgcccttttactgtctggcttggttagagttctttggccaagttcctgcctctgttgttatggtcctcctaccagttcatttagggatcaagagttaatgagtctctcgggtcgtttttgtgaggtccagctttgtaaggagtccttccttccttacgtcttggcttaagacatgtcctgctgctgctaagttgtcacagtcccataggggggcaaaatgagaggagcttttaagacggacttcacgattgcagcattttaaatggctacatgttttatttccttagctttagtgtttctgtagagaaaagagatggatttcaatttttttgcatgtcactctgacaaagttctgtttcccttacagcagccaagaaactaaaataaggctaggcttagtggctcatgcctgtaatcttagcactttgtgaggccaaaatgagaggatcgcttaagcccagtagtttgagaccagcctgggcaacatagtgagacttagtctctataaaaacatttaaggctgggtgcggtggctcacgcctgtaattccagcaccttgggaggctgaggccagtggattgcttgaggccaggagttcgagaccaacctgggcaacgtggtgaaacccgccccccatctctgt

SEQ ID NO: 5854 - DNA, 2564 bp, Homo sapiens
  ENST00000586240
ccgcttccgcctggcgtaggagctgaggcatggccttgttctccagctgagaggacgatcgtccttataggagaggccgagtctccgagggcaatttcagaggtctggtgcgaggtgggggaagcggcgcggcgtcgatgacgacttccttacatcgcccccgacccccgcgttctcttgttaacttctgtgcattgttgcctgtctgcactttccgtctccaaaacctttgctctcctcaccccgttttcccttgtaattataccccagcgatcactagtctgggttcgaagtgattgtgtgtctccataattgacctggttgcccccggttatcccagaagtcaaagatgacagagaaaaaaaggaagagcgaggggcttatctcgtgttctctacgtcagactcctcttcccctgtccttcctgggtgatctttatccttcccagcactgttctttcttaagttaagcaccaaggaagagggcaactgcttgggcgctgttggcactccgaagcagccgcagtggttcgagattgccagtcggactagccaagggagctgctgagtgagtggttttcgagaacgctctagattctggcaacagttaggccagattattggaagtggggttggaacagagttgtgggtagtcatacttgttctaatcctaaagcagaattgacaagaaggttctagaagtttggagccctttccttatcagctgcgggttagtctgacccttttgttcaagatatctacagtgccctcagtctctttgcaacatactttatatcttcataccaagcccgttgtgtcttcaggctgggtaatttgaggcggtgatgtagaattagttcatgagatctgaaatcaggattctgagatttttactatctaatgagttcgaaatataagaagtactcggacgcaatgaatagttatcaagcttgagggtggttaccacagccagatctcaagttcctgatctgctgggagctgaggggcctgacaaagtgtaataggcccctgggatatcagagaagccaggacaccagagtccagtctctgttcttaattttgagctttcatgttgttcctacttcttcctagatatttaaagctaagcatcatcaacccttatacatcattaaagagctgcacaatgggaaacaaaattcctcccagtgcagacggagcttaaattaattgtagagatttacttgtatttggaaagagttcagtggttctttatactgtaaatagggatttggccacaggttatttattttttattttttgagacggaatctcgctctgtcgcccaggctggagtgtagtggcgcgacctcagctcactgcaagctccgcctcctgagttcacaccattctcctgcctcagcctcaccagttgctgggactacacgtgcccaccaccacatccggctaattgttgttttttttttgtatttttagtagagatggggtttcaccctgttagccacgatggtctcgatctcctgacctcgtgatccgcccacctcggcctcccaaagtgctgggattacaggcgtgagctactgtgccgggctggccataggtaattttaaaaactcaccctactcattgtaaatctctgatgtagagtgtccctattttggacttcatttcatagcctcctatcttaagcaaatacatttcttcaatcacagccttagaggatagtctatcataaaattggagtaaatgaacctgaagacatataataaaataggttatgctgtaatgtgaccacatcacacaaaacatggtatttgatagcagtacaacaaaataaggtaaactaccttatttcatggaatttaagtgtcattaggctgggtgcagtagctcacacctgtaatcccagcactttgggaggccgaggcaggtgggtcagctgaggtcgggagtttgaaaccagcatggccaacatggcagaaccctgtctctactaaaaatacaaaaattagcggggcgtggtggcacacacatgtaatcccagttacacgggaggctgaggcaggagaatcgcttgaactcaggaggtggaggttgcagtgagctgagatcgggccattgcactccagcctgggtgacaaagtgagattccatctcaaaaaaaagtcattgattgcagaatgcaaattattttatctgtcactaagaaaatgtaactgtaaattaaacatgacaacatgcattattcctgtagttcaaatagtgacagaaaaaaattaattaaaaaaagaaaaaagactgggcgtggtggctcacacctgtaatcccagcactttgggaggccaaggcgggtggattacctgaggtcaggagttcgaaaccagcctgactaatacggtgaaaccccatctactaaaaatacaaaaattagccaggtggggtgatgctgtaatcccagctagtcaggaggctgaggcagaggttgtggtgaggggagatcatgccattgcactccagcctgggcaacaagagcaaaactccgtctcaaaaaaaaaaaaatcaatt

SEQ ID NO: 5855 - DNA, 3260 bp, Homo sapiens
  ENST00000341772
cgcagctgcaggaggcgcccggcccggcggagcagccctagccgccaccgtcgctctcgcagctctcgtcgccactgccaccgccgccgccgtcactgcgtcctggctccggctcccgcgccctcccggccggccatgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaagga

SEQ ID NO: 5856 - DNA, 842 bp, Homo sapiens
  ENST00000482831
atctctcggccctttcttgtctagatcatattatcttaccttgataaacctttccaaattttctggtcttctatctcgttaaatgcttttgtttttttcctctcaacaaacctgccattctctgagactcccttaagctgcagaacgggaccgaattagcagagtctgactcagacgaagtgagatgggagtgccgaatgacctgagggcactgaattcacttgtgggggttactagctccttacgctttcatttcctcatgaatttagtcactgatcaaagctttactgagcccctgctgcacgccaggagccctgtgctgggggagcggatctgtgcggagtctactgtgatcttctccaggagcactggggagaatgggcagctgttgggatgttgggaagtggtcaggagtctctgggaagaggtaatatgtgggctaggaacacatttccaaggtggagaaggagacaaagcttgggaggattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggtccactgtaacttcaaaggggtgaatggtacaacccatggctgataagaatgtccttgttggagctgaggtcatttcttcaggattatagccatcaaattaaccatggaaccctggaaatcaacaatttgcaggtctttctaattgacgtcttaactggattagaaggtttcccagtcagcccatgactc

SEQ ID NO: 5857 - DNA, 4178 bp, Homo sapiens
  ENST00000543621
ggggaaatgccgaccctattcaaaggagtttggggggttgtggagcattccagagctctgggaagattctgtcccgcctgcttaccctcaggcccacacctccacacacagccagctctgggcactgcagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 5858 - DNA, 5437 bp, Homo sapiens
  ENST00000636706
attatcttctggcctctggagaaagatagagtagctcgctgattggatcctgaggttgaaataactccacatctcactgcgctccgactagagcaacgagaagagtgtctggaatggttgggagacattttaagcaggacaaatccagccttaggctagactgcacctgtccacagcccagcccaggcccatggaaaagaatagtaaaacctttgtctttaagcacatagaatatgtgtgaaacccagaaggctagaaaagaaagggaagtggaggagaaaaggcactgggactccagctgggagtatgaagactacgggagtgtacggaaaaggaaccttacagtgctggatggactctacagagaaaatgacttggatcccaggtactgggccaagggacagcatcagccctacagaaaaagggattgtggatactgggattttgaacagagtgaaccaagctatatggactgtggggaagcacatgaaagtggaaagggctgtgtgtaccacggaggtcatgatggttataggagtccagaaaatgtagattatgagagtctcagccctgggacgaaggataattcacctacgagaagcccagatgtgacctcgaaagctggtggatacggggaggcaaatggctactcagactgtaagaatctgaattataatcctgaggactctaaaaaagctgaacagttgactgactgtaggggtttggatgattcttcagcgaatttaggtcaacctcagttgtggtatatagaccatgagaatgttaaccataatcttgaggattgttgggcaactaatttttattgtagagaacacagcaatttatatcatgttcctgggagttatcctgatggtcagcctgtgagcttttcagattcgaatggtgtcaatgaagataaggaatttatcaaataccatgaaggggacaggaatgttcatcaaaatgacaacatgtatcccaaagcaaagactcatattatggatcagggtgattttgatacagaaaataaaggctatgatgctttatttgcaaactgtgcatataaatctcgtaattccagagggacagattctctccatcaaatggagaatttggagtataatggcactgacataccaagaacaaaggcacatgggggcagcaggatccttctggatggtctgcagactcagtgtaccaggggagaacaaggaggacatcatttggggattcctcagagctcgtcattagagaagaacatctggcatttagaggaagagaaaaaattaaatggcccagagacttggagaaggaatagttgcctccgccgcacagcacccagcaccctgaggcgctcagagttcgtgcaaaacagcaagaaaacccaagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 5859 - DNA, 6400 bp, Homo sapiens
  ENST00000324109
aggggcggaggtgacagcgggctggggactggcggctgcaactgcctgccgcgccgagggaccgccgggcggcggaaagcaggttataaaacatggaggctggctcagtggttcgagccatttttgacttctgccctagcgtatcagaagaactgccgctctttgtgggagatattattgaggtgctggcagtggtggatgaattttggcttctaggaaagaaggaggatgttacaggacaattccccagcagttttgtggaaattgtgaccattcccagtctaaaagagggagagaggctgtttgtgtgcatttgtgaattcacatcccaagagttggataatcttcccctccatcgaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 5860 - DNA, 900 bp, Homo sapiens
  ENST00000472036
tgacaataagcaagcattagtcaattctaatcatgtgagagagtatttttttgcaaagacaaaaaaaggaagcagcacagcaggagctattgggagtgccagggtcggatgggaaaccaggttttgaggatcagtaacatggcaggacagttgtctttgagatggcgacagcatgaaccaagacttgaggaaggagaggtgactggtcattatcgtaatcctataggaatcatcttggttctaatttgataatttgctttttggtaaattaagaaaccctattagggacataggggaatgctaaagagatgataaaagccctcaacagttttgttaagaattaaaagtcttagcctttctctgtgccccgtaagtcatagtttatgaaaatatgcttatttcaaagctaaaataccagactagttagaaaatttcaaattatggaactcatttttccaagactgctattcagtcttggaatgtatgacaaaagctggaaagttctgtctgttctgacttgtgtctgtcctaactggctccaggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttcc

SEQ ID NO: 5861 - DNA, 6048 bp, Homo sapiens
  ENST00000496357
tccgcagcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccacccggcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggcaaataagctcagaacaaaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcagcatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacatacctgaggccagatgtggacaagaaatccaaacataagacagcggtgaagaaaaaaaccctgaacccggagtttaatgaggagttctgttacgagatcaagcatggggacctggccaagaagtccctggaggtcaccgtttgggattacgacattggaaaatccaacgatttcattggtggtgtggttctgggcatccacgccaagggggagcgcctgaagcactggtttgactgcctgaagaacaaggacaagcgcatcgagcgctggcacacgctcaccagcgagctcccaggggctgtgctcagcgactgacgcccacccgccactgctacccctgccgccacctgcgcccagcacggccggccccgggcttccccagcagccaccaaggcctgtggcccccacactgggggagatccagaacccctgcttggacacagagccactgcagtccccgctcggaggatgtggagggctcagccactctgggacggggagggcaaggagctggggtggggggctctcagctctctggggcccaagaggccggtggtggaaagagacctcagcacctgcccaggggaaggggacacgcccatctgggagcaaagacccttctagaggccagccccggctgagaggacaggagtgtgggggcgccttggcggacagtgggaacagaggagggaggtggtgagcagacagacaggtggaggatgggaccttgaagactggctgctccagcccaagaaagcctaactgcatccctcatctccttcgctgctggacagatggaagaagcgggcctgccggccgaaagtctgccagagttcccggaggctcctgatgatgggtaaattggcacatgcttcactcaatgattccacaagccctgggggtgaatgagacacagggcctgccctcagggagttcccatctagtcaggaagctgggaacaaaccattccaactggggtgagaaataccaagaccagcttggccagtctgcaagtaccgtgggctctgctgactctgccgggaggtcagggacggcttcctggaggaggcggtgcttccgtaaggccttggagggtgagtgagggcttctaaaagcagtccaggcagtgggagtggtctaaaacgcctggagagagaaagccaatggggccggggtgctgtggacccagggtctcctctccaggggagggtttgttaggaaggtgtgaggctcgaggcaggaggtgggggacgtgatggaaacaccatggagaaactggtgtaggctcaagttcagacctcagacccaagtctcccactctgatctctttctactcctgagggacctcaaggacggagcccgcccctcctccttcctggcataagcatcaggtcagctgcagtggagaaaagggtcccttgtgcttgggaaaaaaagcaagcattcctacacgtcctgactctgccctttcccctcccctccactccatggctcacactgggggcctccgggtgcttgctcgtggcatcttggtcccactaccgccacagatgtcccttttgggagtaatcagtggccgtccagggccttgtctctggggaggcctgtggggccagctccaccctccaggagctgagcaagaatcaccctggctggtgggcctgtctgctcccctgagtgagactccccaggaggcttgagagtatctgaatcttggggcccatgcctgaagcccacaaactttctctgcctaccaagggcccctcaggaacgctgggtgaacaaatgcagagccaaggagttgcacagccagagtcccagtgtgctcagcccatcagtgtgtgatggaaacaggcccagagaggtcaggtgacctgcccagggccttccaggccccacacagctggaaccaggatccacagcccccagcccagagtgctggacaccacgcttcaggggaattggcgtgctgagctcacaccagagaggtcctgctagctgccagcctggggctcccccgcctgctgcccaccccttcaacaccgatagagggactcacaggcacgacggtgggaccttccactgcagacacaaagcacaccaccacctgaggtccagggttatgatttgaatcctaccaagtgcccatcaggcctttcccaggttgcggggaaaacaggaccccagcccccacacagtccctggccacctgctgctcctggagacttgtctccctgcctttaggaagggtttttgtgtgaaggtttttgcatgcactggtctgaacgcatgttcacagccctgcaaggtgggtttgattctcatccccatcttgcaggtgaaacaggttcccagagtctgagtagtttgccaaggccacacagccaggaaggggtgaaccaggactcaaacccaggtcctctgactgccgctttctctctctgggggtcggtacccccagtcccttccctcttggtctgtcggagactcagcagagacaccaggtgaaggctcagtaagctcaggtgcatgatggagacctggggtcttgtcactgtcctgccacctcatccgctggctttgaaaccatccgtgctacttcaggcttccccagaggtgtctaacctggccccaaaactcagccaccccaccctagcctctgggggctgaggcaagggctcctcttttctccacacagaatgggcaccctctgggggcctaaggtaagaggtggtctatttctaaaaggcctggtgtctagttaagctctgggtatcttcttagctttgcttttttgggggtctcattcagagaggagatttgacagcctctctgaagacacagaagtgaatggcaaagcgagaagaggctgtaccccccacctaccatgacttccttattaggcacatggggaatgtgaggcccagtgggtgaaaggggcctgaaggggcacagctgggacaagaacccagaactccagccccccagtccagggccctctactgcccaggctgtgcaaatggggctgggaccgaaagatggggacagtcaggctgggaggcgggcttactggccagccagcccaggggcagcacaggcactcgggcaggaactccccaggaagtttggatccttccttccctaggatctcagcacccttttagatcccgtgcagattgtctttctgttaaagcgttttgaggcacgatggctcacgcctgtaattgcagcactttgggaggccgaggctggcggatcacctgaggtcaggagttcgaaacccgcctggccaacagggcgaaaccccatctctactaaaaatacaaaaattagccgggtgtggtggcgcacgcctgtagtcccagctactcagggaggctgaggcacgagaatcgcttgaacccgggaggtgaaggctgcagtgagccaagatcgcggcactgcactccagcctgggcgacagagcaagactccgtctcagaaaaaaaacaaacaaacaacgctttgagaagctgcagaagcggctctgcctttgaccccgaatgggcatctttactcgggtccatcatccccacaaagacaggaaatctgatgccaaaaaaaaaaagtcattccaggtgtcagtaaccaggcgctgcctccagcgccgccccgcccgccgccccgcccgccgccccgcccgccgcctgcgccaatccccgacgggcccgtcttccagccccgaagcggtcacctcctgacctctagtggcgagcgcggggaactgcgccccggcccgtccgcccgccgagcccgggccgtgcatgccgagcccgttgttccttcgcaaaccgagtgaacctcccgatgcatggactctggctgtcgtcgacgcagactctcgtgcactgcttaaccccgttttgctgccatgtgacggctgcagacactgtcctcaaactgcagtcccacagacaagttttgtattttggtctgacctacccgaaggtgtcctttttaagtcttatttgttaatatttataatgacatataatccaaagtaaatggaaacgtcatattgcgatctcattgccttggcgagactctcaccttttaatagatttgaaggggtgggggcggtggctcacgcctgtaagtcctagcacttttggaggtcgaggtgggagaattgcttgaggcctggagttcgagaccagcctggtcaacatggagaaaccacgcctctacacacacagagacacacacaatgacaattagcctagcgtggtggcacacacctgtagccccagcttttcaggaggctgaggtaggaggaggaggatcgcttgagcctggaaagtggggattgcagtgagccgagatcacgccaccgcactccagcctgggcaacagagggagaccttgtcaaaaaaaaaaaaaaaagatttggaagggtaggaggggagggtggaaagacggaggaaaaggcaactgaaacctactccggatatagtcttgttactcttcaccagggacccatttgaggtaggccctcaagttacagatggggaaactaaggcccagagaggttaaaatacttttacagaatcacacggctggtcgatggcagaagcaggattcaaactgaggcagcccaagacattttgcaccaggacctgtcgaccatgctgttgtccactcatccaacaaacagccgtggagtattgactaacgccagcccgtctgaggctccaagagtcttacgttttggaaggtaatttaagacatgtactgcttaggtttggagggaaaaaaataaaccttcctaaccacagattagtgtattaggactagtagcaatccccacactttatattttcattccaccttgttagaaaatgttgatcaattgttgaatacagtttattgtacatcattctttaggtcagaaatttctcgagataaaagcctttgctttctaacatcga

SEQ ID NO: 5862 - DNA, 578 bp, Homo sapiens
  ENST00000633410
aaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcagcatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacgtgagtgtgccgtgcgcgtgaccacctgccacgtcttcacctccaaggacgggggtccgtgtgccggctccgtggtcccaggtggcaggcacccagggagtgcctgaggtacaggggcgctgtgttccctgatgggctaccttggcaactccaggggttaagcatggccagcccatttcacagatggggaaactgagggac

SEQ ID NO: 5863 - DNA, 418 bp, Homo sapiens
  ENST00000633635
cggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggacttctcagagcatctaacgtgttgatgggctgttccctgactctccgcaagggggatgaagtgggcagaatctgcccctcattcctacgccggatgacccaagcgtccgaccacacatgtgctcagggcaccagcacaacaggtgcatctcggacaggagagagaaaaattgctgttaaataaaagcatcaaggtga

SEQ ID NO: 5864 - DNA, 6048 bp, Homo sapiens
  ENST00000613549
tccgcagcggagcgggcagcggccaagtcagggccgtccgggggcgcggccggcgatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatggccatcgacgtgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcactgccctgggcacgctggacttcagcctgctgtatgaccaggagaacaacgccctccactgcaccatcaccaaggccaagggcctgaagccaatggaccacaatgggctggcagacccctacgtcaagctgcacctgctgccaggagccagtaaggcaaataagctcagaacaaaaactctccgtaacactctgaaccccacatggaacgagaccctcacttactacgggatcacagatgaagacatgatccgcaagaccctgcggatctctgtgtgtgacgaggacaaattccggcacaatgagttcatcggggagacacgtgtgcccctgaagaagctgaaacccaaccacaccaagaccttcagcatctgcctggagaagcagctgccggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacatacctgaggccagatgtggacaagaaatccaaacataagacagcggtgaagaaaaaaaccctgaacccggagtttaatgaggagttctgttacgagatcaagcatggggacctggccaagaagtccctggaggtcaccgtttgggattacgacattggaaaatccaacgatttcattggtggtgtggttctgggcatccacgccaagggggagcgcctgaagcactggtttgactgcctgaagaacaaggacaagcgcatcgagcgctggcacacgctcaccagcgagctcccaggggctgtgctcagcgactgacgcccacccgccactgctacccctgccgccacctgcgcccagcacggccggccccgggcttccccagcagccaccaaggcctgtggcccccacactgggggagatccagaacccctgcttggacacagagccactgcagtccccgctcggaggatgtggagggctcagccactctgggacggggagggcaaggagctggggtggggggctctcagctctctggggcccaagaggccggtggtggaaagagacctcagcacctgcccaggggaaggggacacgcccatctgggagcaaagacccttctagaggccagccccggctgagaggacaggagtgtgggggcgccttggcggacagtgggaacagaggagggaggtggtgagcagacagacaggtggaggatgggaccttgaagactggctgctccagcccaagaaagcctaactgcatccctcatctccttcgctgctggacagatggaagaagcgggcctgccggccgaaagtctgccagagttcccggaggctcctgatgatgggtaaattggcacatgcttcactcaatgattccacaagccctgggggtgaatgagacacagggcctgccctcagggagttcccatctagtcaggaagctgggaacaaaccattccaactggggtgagaaataccaagaccagcttggccagtctgcaagtaccgtgggctctgctgactctgccgggaggtcagggacggcttcctggaggaggcggtgcttccgtaaggccttggagggtgagtgagggcttctaaaagcagtccaggcagtgggagtggtctaaaacgcctggagagagaaagccaatggggccggggtgctgtggacccagggtctcctctccaggggagggtttgttaggaaggtgtgaggctcgaggcaggaggtgggggacgtgatggaaacaccatggagaaactggtgtaggctcaagttcagacctcagacccaagtctcccactctgatctctttctactcctgagggacctcaaggacggagcccgcccctcctccttcctggcataagcatcaggtcagctgcagtggagaaaagggtcccttgtgcttgggaaaaaaagcaagcattcctacacgtcctgactctgccctttcccctcccctccactccatggctcacactgggggcctccgggtgcttgctcgtggcatcttggtcccactaccgccacagatgtcccttttgggagtaatcagtggccgtccagggccttgtctctggggaggcctgtggggccagctccaccctccaggagctgagcaagaatcaccctggctggtgggcctgtctgctcccctgagtgagactccccaggaggcttgagagtatctgaatcttggggcccatgcctgaagcccacaaactttctctgcctaccaagggcccctcaggaacgctgggtgaacaaatgcagagccaaggagttgcacagccagagtcccagtgtgctcagcccatcagtgtgtgatggaaacaggcccagagaggtcaggtgacctgcccagggccttccaggccccacacagctggaaccaggatccacagcccccagcccagagtgctggacaccacgcttcaggggaattggcgtgctgagctcacaccagagaggtcctgctagctgccagcctggggctcccccgcctgctgcccaccccttcaacaccgatagagggactcacaggcacgacggtgggaccttccactgcagacacaaagcacaccaccacctgaggtccagggttatgatttgaatcctaccaagtgcccatcaggcctttcccaggttgcggggaaaacaggaccccagcccccacacagtccctggccacctgctgctcctggagacttgtctccctgcctttaggaagggtttttgtgtgaaggtttttgcatgcactggtctgaacgcatgttcacagccctgcaaggtgggtttgattctcatccccatcttgcaggtgaaacaggttcccagagtctgagtagtttgccaaggccacacagccaggaaggggtgaaccaggactcaaacccaggtcctctgactgccgctttctctctctgggggtcggtacccccagtcccttccctcttggtctgtcggagactcagcagagacaccaggtgaaggctcagtaagctcaggtgcatgatggagacctggggtcttgtcactgtcctgccacctcatccgctggctttgaaaccatccgtgctacttcaggcttccccagaggtgtctaacctggccccaaaactcagccaccccaccctagcctctgggggctgaggcaagggctcctcttttctccacacagaatgggcaccctctgggggcctaaggtaagaggtggtctatttctaaaaggcctggtgtctagttaagctctgggtatcttcttagctttgcttttttgggggtctcattcagagaggagatttgacagcctctctgaagacacagaagtgaatggcaaagcgagaagaggctgtaccccccacctaccatgacttccttattaggcacatggggaatgtgaggcccagtgggtgaaaggggcctgaaggggcacagctgggacaagaacccagaactccagccccccagtccagggccctctactgcccaggctgtgcaaatggggctgggaccgaaagatggggacagtcaggctgggaggcgggcttactggccagccagcccaggggcagcacaggcactcgggcaggaactccccaggaagtttggatccttccttccctaggatctcagcacccttttagatcccgtgcagattgtctttctgttaaagcgttttgaggcacgatggctcacgcctgtaattgcagcactttgggaggccgaggctggcggatcacctgaggtcaggagttcgaaacccgcctggccaacagggcgaaaccccatctctactaaaaatacaaaaattagccgggtgtggtggcgcacgcctgtagtcccagctactcagggaggctgaggcacgagaatcgcttgaacccgggaggtgaaggctgcagtgagccaagatcgcggcactgcactccagcctgggcgacagagcaagactccgtctcagaaaaaaaacaaacaaacaacgctttgagaagctgcagaagcggctctgcctttgaccccgaatgggcatctttactcgggtccatcatccccacaaagacaggaaatctgatgccaaaaaaaaaaagtcattccaggtgtcagtaaccaggcgctgcctccagcgccgccccgcccgccgccccgcccgccgccccgcccgccgcctgcgccaatccccgacgggcccgtcttccagccccgaagcggtcacctcctgacctctagtggcgagcgcggggaactgcgccccggcccgtccgcccgccgagcccgggccgtgcatgccgagcccgttgttccttcgcaaaccgagtgaacctcccgatgcatggactctggctgtcgtcgacgcagactctcgtgcactgcttaaccccgttttgctgccatgtgacggctgcagacactgtcctcaaactgcagtcccacagacaagttttgtattttggtctgacctacccgaaggtgtcctttttaagtcttatttgttaatatttataatgacatataatccaaagtaaatggaaacgtcatattgcgatctcattgccttggcgagactctcaccttttaatagatttgaaggggtgggggcggtggctcacgcctgtaagtcctagcacttttggaggtcgaggtgggagaattgcttgaggcctggagttcgagaccagcctggtcaacatggagaaaccacgcctctacacacacagagacacacacaatgacaattagcctagcgtggtggcacacacctgtagccccagcttttcaggaggctgaggtaggaggaggaggatcgcttgagcctggaaagtggggattgcagtgagccgagatcacgccaccgcactccagcctgggcaacagagggagaccttgtcaaaaaaaaaaaaaaaagatttggaagggtaggaggggagggtggaaagacggaggaaaaggcaactgaaacctactccggatatagtcttgttactcttcaccagggacccatttgaggtaggccctcaagttacagatggggaaactaaggcccagagaggttaaaatacttttacagaatcacacggctggtcgatggcagaagcaggattcaaactgaggcagcccaagacattttgcaccaggacctgtcgaccatgctgttgtccactcatccaacaaacagccgtggagtattgactaacgccagcccgtctgaggctccaagagtcttacgttttggaaggtaatttaagacatgtactgcttaggtttggagggaaaaaaataaaccttcctaaccacagattagtgtattaggactagtagcaatccccacactttatattttcattccaccttgttagaaaatgttgatcaattgttgaatacagtttattgtacatcattctttaggtcagaaatttctcgagataaaagcctttgctttctaacatcga

SEQ ID NO: 5865 - DNA, 578 bp, Homo sapiens; identical to SEQ ID NO: 5862
  ENST00000343572

SEQ ID NO: 5866 - DNA, 418 bp, Homo sapiens; identical to SEQ ID NO: 5863
  ENST00000609727

SEQ ID NO: 5867 - DNA, 6797 bp, Homo sapiens
  ENST00000280333
ctccgccgcaaactttttcctccccatcctgtcgcggctcgaaaggaatggaaaatggcggcctagacgcggagtttcctgcccgacccgcggcggctccggcggcgccatgacgcgctgggtgcccaccaagcgcgaggagaagtacggcgtggctttttataactatgatgccagaggagcggatgaactttctttacagatcggagacactgtgcacatcttagaaacatatgaagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagatataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccattgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcaggcatcggtggactccgggatcgtgcagtgacgtcgcaagcctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttccgtttattataataggcgtccaccaatgattatccatatgtgttcttaatttttaactgctggaagtgttaaaacacacacacacacacacacacattttttttttgagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagac

SEQ ID NO: 5868 - DNA, 5761 bp, Homo sapiens
  ENST00000623213
atggaaaatggcggcctagacgcggagtttcctgcccgacccgcggcggctccggcggcgccatgacgcgctgggtgcccaccaagcgcgaggagaagtacggcgtggctttttataactatgatgccagaggagcggatgaactttctttacagatcggagacactgtgcacatcttagaaacatatgaagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagatataataaatggaaaagtagatgatgaagataagcagcatttcattccctttcagccgctcgcgttggacgacgccattcgacacaagccgctgaacatgtcatcccgtttttcacccagggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccattgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcaggcatcggtggactccgggatcgtgcagtgacgtcgcaagcctctctggaaagagtgtgctgcccctcc

SEQ ID NO: 5869 - DNA, 666 bp, Homo sapiens
  ENST00000473861
cagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattgtaagtgcttggtgacatatgtttggatatttaactggggctgacagcatccttctccaactgctgtttgaacatagcttattatactgcaatgtagtgagcagttgagatacagcttggtatataaaatgtcctcattttccaaatgaatgtcaaagttgaagggtaagcaaaccaactttaaagatggaaacatttggctcttgttttctcattacttacttatagcaaaagacatgtattttctgctgagtcgtcattcttctggcagtttctccatagtgtttacacttaaggtgccattaataaaattttatgaaggaccctaaaaa

SEQ ID NO: 5870 - DNA, 779 bp, Homo sapiens
  ENST00000484400
ggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagagctttgaatggactgaagcggcaccttctatcattgtaaataaacctctccaaagctccatgaaagccgagatccttgccggcccctccagctctgtaaccccagtttgcatcatgcaccgctcatgactcagtatcaagaagcaccattgttgcatgggtttccttcccctgtttggacacccggagggtcttgcttcgtctctttctgcctccgtttcactaatttctcactgctgtcggtgttcctttcataagtccttttgagaagagttctgaaattgcattggtgttgccacgtcatcagtctctgtttgtcattttataaatacctctgcaatatctcgactgttctaaggcttggccaactccatgctgctagctgaggttagagattccag

SEQ ID NO: 5871 - DNA, 539 bp, Homo sapiens
  ENST00000495574
catgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataagtaagtgtggggaaaacggctctcaccttttctatggctcccaattcatgtctgctgggaacagtggtgttgcctggagaccaagctggcttcaataaaatgctctgcaaacgctgttcctaattctgtgctgcagacagttctagggagacagggactctgagtttgtggtgacttccttatgacaacacagggctctggctctaagaacttgagctccgtcccctggagaaaaacagcctgaagctggatctcccctagctgtcatcatgggcacaggggttctgctcgacgtcgctctgcgctctcatgttacccacatatttgtatcagccctaggcactgtcagctccatgcaa

SEQ ID NO: 5872 - DNA, 323 bp, Homo sapiens
  ENST00000464466
cacttgatcaagacttttgggaaaatgaggactgatgtggtagatttcctaatggaaacattcatcatgtttaagaacctcattggaaagaacgtttaccccttcgactgggtgatcatgaacatggtgcaaaataaccaactgcatgacatcagttccatcacaactgcaggaggatggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtg

SEQ ID NO: 5873 - DNA, 786 bp, Homo sapiens
  ENST00000410074
gcgggcggcgcgggcacgggcacgggcgcgggcggcgcggcgaggaggcggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaaggcaattggttccaggacccccacaataccgaaatccatggatgctcaagtctctgatataaaatggcatagtatttgcatataacctctgcatttcctcccgtgtactttaaatcatgtctagattatttataatacctaatacaatgtaaatgctatgtaagtagttattataccgtattgtttagggaataatgacaaggaaataaacctctgcttactttttttttctatatttttaatcatcagttggttgaacccatgatatggagggccttgtgtatataaaaatcagtctagctaatagtgccattgttgttggctttgaacagtagatagatagggttcccccaggatctaaatgataaattctggattttttttaaatttttttgtgttcattaaagagtgcttaaaacctttaagcttaaaa

SEQ ID NO: 5874 - DNA, 2166 bp, Homo sapiens
  ENST00000481100
ggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcagtaagtactttggcatgtgtcccaggtgacttgagacctggattagccattcaattgtcttttaacacagaaacaggtgttagaaaccattttctcagagaaggaaagattctaagctgcaagattgtcagataggagctgaacagaagactttattcaaagtccttgatgttggactcccattgaagagggtaaactgaactttcctgattctatagaaagcatcaaaggaatataaaagggcacatatctgtctgctctggaatgcagagagggtgccgtccttgtgtcagcaatgccaaaatatatgtgcagtctattgcatgaaacaggcatcatggatgacacggaatcacgtgggctagcatagggcttctcagactgcatcatgcatatgaatcaggggaacttgttaggctgcaggggagttctgcctctgacaagctcccaggtgatgctgatgtagctggtctgagggccacactgtctgtagcgagggtttaggagatgagagagtgaagggctgacccacccatgggccagtgttcctgcatgttgggggaaagccagcctgggagcatgtgaaaggatccttgcagagctttactgaggccctccatattgagctgcaggagctggagccatgggtaggccattgaggagctgttgggagcagattcaagccgtgtcactctgaagaagtgcaggtgtgaacgtcatgacctgctccagcacctgcacaggcagtggaggcctagtggaggccaagagcattgccgggaccaagtcccaccaggggccatcgtgccagtcagagggcatcatctcagctcacttgcagctgccactgcagacaagtagaacaaactgagaattccacaaaccagccagagtcatatatttgagttaatatatcactttttacaaatgatatcacaaattagtggagaaagatacattatgcaaaaaaaaaaaaaaaa

SEQ ID NO: 5875 - DNA, 10075 bp, Homo sapiens
  ENST00000276440
tgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggggtggccttcgtgaagctgatgaacccggatggcaccactctgcaggatgggaggcacgatctggtggtttataagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaaatggagcgatttaggtgaccaaatattacatacataaatagccacatgaagttttagacgtttggacttgaagcctcaaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatcccagttatgacatctgttaactttgcaaactcacaaaaattatttgaaattatctgagttttcattttctcaccttccagaatggggataatgcctcctgcatcggttgttgtgaggtttcaatgagatgaaatatgggaaagaagaggtactcacctgatggtccctgctttcctctgctaggcctgagtaggaactggaactctctaagagcattactcatactttttttttcttccaaggtagtttggaatgtgagtgcaagttagttctgcacatacagcccttctccaaatggtggtttcctttgaggtcttttacatgattatttatgactagagacaaacttaataagaactcaagaggattttaaatggagagaactcaagctgtagagaaaggaggaggcaacagacaggatatgtaggggcttacctagagcctggcacgacttctgagaagtcacccagcagaccggctagaggggatttgtgtgccacactctacttgccgggctgccattaaaatagaaagatataaaactgggtcaccaaaaaaaccaaacctcaaggctatccttccagagcagtagaaatgagtcccacagcctggtctttgagcagaggctgggaagataggatacatcactgtctggataccttctctttttaatagaatatattccgtatgattccctttccaccttaatggaaataatagctctctcctgcctgaacaaaagggattccaggtagtattgtggctaagagattacagcggacgatggaaggttcattttttagggaaggtgttgggtaggaagagtcacatttgacagaattcataaataatgtgtcctgaagtcagaggatgactgcaaagaaacacctcatgattccattaaatataaagagataaggagcaaggaggaaaaaagagaaagaattggtctttatttttcttgctaagaactctctggagtattgaaagacattgaaattatccctaaaattgtcacaacttttgtgaatactggtatacggttggaggtgtttttaaatctttatttcctctctttctttgttctagtgacttgtcttgctttaagattttttttaaaggattgttttattcaacatatatcaagttcttatggaatgccagtcatggtactagccccttgggatgtagtggttgagtgtgttcaatggaaacagccccagtatacaaagacagttcactctggtgtgctgtaggattggaaagggagtggtaccagatgaaaatgaaaccctaaagaagactgctgggccatgagttgcttcctcctcctccaccttaaccctctgattccagaattgcagtcattttcttctgccaaggaaatccattaaaaactgcagccacactgcaatttcctaatgtagaacaagatataaagcaggctttgagacaacaacctacctttgtttactctttccaagctggaagagtccttctcctctagttgcccctaggtcactggctaatttattttaaaatttagatggaactcatgtatagttaagtgcacaaatcttagccgtgcagatgggtaattttcacatagctatttgcccacatccgtgcctctaagatagagacatacactgttttcagcaccccagaaagttcccacatgcccatggtgccattttgtgaaaggtatttataaggcccttcaaatttgtggcttcctttctcatacttctcaggtataatgaaagggggagaaaaaccccaccatcaacacaaaacaaggctataaagactgtgcaccttttaacaagtcaatttgtagtcagtccctgggcctgtctttttttttttttaattttgaagctacctgaggtttagaattccttcagccctagctgcttttattctgctttttatttaaacaaaaagagggggaggatctgaaggaaactagttttctgtacaaaggctttgaggtccatggactatacttgtcccatttatcatcccaggtggtgctttgaccctgccataccctggctattaagataaaaagatttgtggacattaaaattatgaatatgtcagtaataatccagcacacattgaaatattgacacagattaccataatttgtgcaacatcttataaacaatgtcatttccatagtagtctaaggcttcaccagcctggcccactgtatctagactttaggttcattttaataattatgctttccttctctgtatcatttgggaagttgataaatatcacttccttagataccttcattcagtgatatatctggcttttacaattaaattggaaaaggtaagtttctctttggtgggttgagagttggaccatcaattctaatctacaaaaggaaattcatgatttcactctgacgcctaggatctagccaaggctggtctgcagtatcagatgtccaaactcatctactattagccatattttgtgagtcgtttgtctaaactttgtcaaaaatgcctttgccatgattttgttgctatctggatttcaaacatggacagttaggaagatgtgcattgaagtaggaaaattttgttcagatttgctgttatttattttttaaattaaaaatggaaatgtattttaaagttta

SEQ ID NO: 5876 - DNA, 594 bp, Homo sapiens
  ENST00000495236
cattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcaggtagcagagacccacatcccctgctgctgacctaacaaagatacccagccttcccctgacccctacccgggcagctctttgccagatttgagaagagaaaatagggaagcatggaagatttctaagcagtagaatgtaaaatcatatggtctatgaagccttcatatgtcactactagaacaatgaggccagtttgtatactctctgggatttagagatcacataaaactcattagggcttggagatgggaacaaagaattcaaaacagtgtgtgggagggtgagaaagggatgaataggcagagcacagaggatttttagagcaacggcagtattctgtatgatgctatagtggtggatgcatgtcat

SEQ ID NO: 5877 - DNA, 5335 bp, Homo sapiens
  ENST00000444569
agtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcaggaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggggtggccttcgtgaagctgatgaacccggatggcaccactctgcaggatgggaggcacgatctggtggtttataagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcaggtgaatggctcagagagcttgtttcaacagggtggagtacagtgtcctttcagactaaattctatacatttcatgattttgatgggaaagaactttattccaggaatatccttttatacaagtttttttagttctttctaaataggcacagctaatttgtagatcaagtatgggaaaatgtcagttatcttttatttaaaaatccttagaaagcagagcacgacttatgaacctttggtaattgacactctaattaaagcaataaaacacacattgatgaatacataaaaaaatttgtaaaactgcagaaaactgcagaaagatgagttataagtgaatatagtaccatagaagtactctatttttattctctccctaaataaatgtatgttgtggtttagatataaatacatctatatgttatgaatcccaagtaattatttctagccctgagcaccttctctaactttggatttacatataaactttgattggccaatatgcagctcaaactgaacaaggcggtaacaggaacctttatttctcactctttgctcctccccagcccatcctacctcactttgttaccatgttactaataacattcccatccatttagttgctcaggcaacctcatagtcatcttcaatttctctcttttactcaccacctcccacattctccacaagcgagagatgtggcccctctgttcagaacatgcccctaacttatccgcttttctttttctttctttatttttttttttaaagagatgagatcttgctatgtttcccaggctggtctcaaactcctgggctcaagcaatcctcccacttcagcctcccagagtactaggattacaggcatgagccaccatgctagccaatccacttttctttatctccctgactaccaccttggtccatcccgtaagcatgtcacaccttgagcactacagcagcctcctgtttggtgtctctgcctccagttttgttctcagctattaatattcttttacagtttatattttatactaaagtaatatatgggcattgtccgaacatatgagttaaaaataggattcctatgcctcaccacttcccaaaggaaattcacaattcatatttaagtttagggcattaaaaagcttattgtataatggactgggcctggtggctcacgcctgtaatcccagctctttgggaagctgaggccagcagatcacttggggtcaggagttcaagaccagcctggctaacatggtgaaaccccatctctactaaaaatacaaaaaattagcaggcgtggtggcacctgcctgtagtcccagctactcaggaggctgaggcaggagaatcatttgaacctgcaaggcggaggtttgcagtatgctgagatggtgccaccatactccagcctgggtgatagagcaagactgtgtctcaaaagaaaaaaaaaaaaaaaaagcaacctactgtatatagcttagaaagtgaggcttgttgactgtggatttcgccattgtatgatcagaaagaaatccccagtgtctgtaactgtaggtcttttcatttgggaaactcaggaaggtaaactctcctatcctggtgtaagatatgaggtatgaatgcagctttttttccccccagattgctattcaatagagatgctgtttgttaagtatagttcacattttgcttattggtataagatcccatctttattactaaattcttattttggggggagggaatctctttctagattgtatatgcttttacgtgggtctctgtctgttcatgtaccagtaccatactgtattaattattaattcttgatagtgtgttttatgacctggtagttactcttgattgctcttctttttcagagttttcctacctattcctttttgttaatttttccatatggactttggaaagatgaaatttaaaaattaatttagtgagaatttacatgttaatgaaatagaattttcttatccaaaagcatggtatgactttccatttgttcgagtctgcttttgtgcccttcaatggcgtgtgaaagttttctgcatataagtcttgcatattccttgtaatgttcactcttagaaatgttctttttggacttatttttgtttggttccattcttctattctgtatatttagtctccgtgtatctgaaataaattttatttcaag

SEQ ID NO: 5878 - DNA, 288 bp, Homo sapiens
  ENST00000478099
cctttctccccctcccaccttacctcttatttctctttcccaagaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatg

SEQ ID NO: 5879 - DNA, 429 bp, Homo sapiens
  ENST00000487948
acacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggaggtgcgcggcatggcccagaaatcctgctaccatcgcatccgtctttacaatcacgatagaatcttggccgtattttaattcttctttgcatcaggatgggtttgatttttcctgagaaaagaaatataaagcctgttaaatttgtgattagcagtgagcagtttcactaaggaagctatctagactcttctagactcttatttttatatttctcctgtgctaagaaatagctccagcca

SEQ ID NO: 5880 - DNA, 4844 bp, Homo sapiens
  ENST00000467709
gatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagttttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggatgggtccagactgtttgcagactggccatggtccttgggccacactggaagaagaactgggctaagtattttttatgcctgtgatttaacttctccaataaaccgcagctcttgtaggatatgatggtcgctaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttga

SEQ ID NO: 5881 - DNA, 780 bp, Homo sapiens
  ENST00000481728
cagaatacgtcatgctaatgggggtcccccaaaactatttgttgagtcagtggccacagtgagctctcagtgaacctgagcaatctgagttattaagaaggcactcatccctgcacagccacattcatcttttaagtgttatgactgatcattttcaactattttcttcataaagttatatattattctgtgagaccattttccacttttggacaagagattgctttgtagggaaaagccaaaaagagatctaaagacaaaactcatctatctgaggttccttaaagaaagtgaaactgagtcagaaggaatggagtcaaatcctgtgttccctgcagggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcaggtaggcatgtgactcacctacctgcttctagaattcttggccatggcaagagaactatatgaatttggaaaat

SEQ ID NO: 5882 - DNA, 459 bp, Homo sapiens
  ENST00000463457
tctccagctactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggttcgcttggtcccagaatcccctagggattcacagacctgggtgtctgtgtgcctccctctgtgccatttgccactgacaaattcatttcctacagctgctc

SEQ ID NO: 5883 - DNA, 1836 bp, Homo sapiens
  ENST00000521405
cagttacagtttcctggaggaagtggatattttcctaagcacttgggctatatcagagaacagaataataccatacattccagaaaatgttgtcatcttcagcttaatactaaaaccctgaacaaaaaaagttttggccaggcacggtagctcacgcctgtaatcccagcactttgggaggccgaggcaggtgaatcacgaggtcaggagatcgagatcatcctggctacagtgaaaccccatctgtactaaaaaatacaaaaaattagctgggcgtgatggtgggtgcctgtagtcccagctacctgggaggctgaggcaggagaatggcgtgaacccgggaggcggagcttgcagtgagctgagatcgcgccactgcactccagcctgggcaacagagcgagactccatctcaaaaaaacaaaaataaaaaaaataaagtttttgcttcagaacaccttgtggagctcttgaaacttctggcgagggcgtcacctgtgtgatgtggggtaagaagtcttcttcgttctatccgcagaaaccatagaatgtggctttcatcagttggttgaccaggttggcttaggtgttacagtgccagcaacatttccatgagcttccttgctcagtgcctctctctgccgcctgcactttctgtcatttctaggctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgatt

SEQ ID NO: 5884 - DNA, 1042 bp, Homo sapiens
  ENST00000479547
tggttgaccaggttggcttaggtgttacagtgccagcaacatttccatgagcttccttgctcagtgcctctctctgccgcctgcactttctgtcatttctaggctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggttgtggatcacatcattgcctaattttattaaagacggagtgaagacattatttgattccactttagagactcttccaatggaggtatttgggaaacctgtcattgtgcagtagcaaatatttgtattaaaaagaggcggttttccccca

SEQ ID NO: 5885 - DNA, 1249 bp, Homo sapiens
  ENST00000586702
atgtctgccccatcctccccggatcggccttgccccagcgcgtgttcgggacgtatttccgcgtgggcttctacggcgcccacttcggtgacctggatgagcaggagtttgtgtacaaggagccatcgatcacgaagctggcagagatctcacaccggctggaggcacgtccttgtggttgggggtggaacggggcatggggctgccttggggctggagtaggggctgtccctgggtggccccgagtcagccctgtgtctccaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 5886 - DNA, 6358 bp, Homo sapiens
  ENST00000294618
gacgcgaggaccatggctgcctccgagcgccgcgccttcgcgcacaagatcaacaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtatcagtacctgagtgcagcatacagccccgtcaccacagacacacagcgggagcgacagaagggcctcccccgccaggtctttgagcaggatgcttctggagacgagaggtccggccctgaggactcgaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagttcgagattgaaattgagcccatctttgggatcttggctctgtatgatgtgcgggagaaaaagaagatctcggagaacttctacttcgacctgaactcggactccatgaaggggctgcttcgggctcatggcacccaccctgccatctccaccctggcccgctctgccatcttctctgtgacctacccctcacctgacatcttcctggtcatcaagttggagaaggtgcttcagcaaggggacatcagtgagtgctgtgagccttacatggtgttgaaagaagtggacacagccaagaacaaagagaagctagagaagctgcgcctggcggccgagcagttctgcacccgcctgggccgctaccgcatgcccttcgcctggacggccgtgcacttggccaacatcgtgagcagcgctgggcagctggaccgggactctgactcggagggcgagcgccggccagcctggacagaccgccgccgtcgggggccccaggaccgggcgagtagtggggacgacgcctgcagcttctctggcttccgtccagccacgctaactgtcacaaacttctttaagcaggaggctgagcgactcagtgacgaggacctcttcaagttcctggctgacatgaggcgcccgtcgtccctgctgcggcgactacgtcctgtgactgcccagctcaagatcgacatttctccggctcctgaaaatccccacttctgcctctcccctgagctgcttcatatcaagccctacccggaccccaggggccggcccaccaaggagattctggagttccccgcccgcgaagtctatgccccccataccagctacaggaacctgctgtacgtgtacccgcacagcctcaacttcagcagccgccagggctccgtgcgcaaccttgctgtgcgagtgcagtacatgacaggcgaggaccccagccaggctctgccggtcatctttggcaagtccagctgcagtgaatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccggagaatgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 5887 - DNA, 312 bp, Homo sapiens
  ENST00000587734
cgtaagacgctgctcagcaccgaccacgccttcccctacatcaagactcgcatccgtgtgtgccaccgggaggaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggttttt

SEQ ID NO: 5888 - DNA, 4009 bp, Homo sapiens
  ENST00000587656
gctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagggcatcgatcgctcacactcctgggtgaattccgcttatgctccaggaggcagtaaggctgtgctgcggcgggcgcccccttattgtggggccgaccccagacagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccggagaatgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctga

SEQ ID NO: 5889 - DNA, 444 bp, Homo sapiens
  ENST00000588666
ccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgccccagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgataccta

SEQ ID NO: 5890 - DNA, 280 bp, Homo sapiens
  ENST00000592463
ctgctccgggaagcacttcactgagctggggctggtagggttgctggaacaggcagccggctacttcaccatgagatgggatcttgctatgttgcccaggctgggcttgaactcctagactcatgcaaccctctcgcctcggccttccaaagtgctgggattacaggcgtgagccagcatgcccggcaactgattttccactgtggaaaaggggttttcttctctagtttgcttgtttgtatgagggcagttggtggtttctacatttaacttgcaggag

SEQ ID NO: 5891 - DNA, 566 bp, Homo sapiens
  ENST00000588429
atggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtggtaagagggtgacatacccacgtgtccccatcccaccagctgctcccaccttgtgtcaaggggaccccatgaagggggccatccctagcttactttctgcctcacttttcctggagagaagtccacaaatcatcaccgtacacatgcgcctgtgcgtccccatctgtcactcgtgtttgcccctgtgcgt

SEQ ID NO: 5892 - DNA, 459 bp, Homo sapiens
  ENST00000592403
ctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggtttgagggcgtgggcaggagatgatggaggaggcaggctaaggatgtacccagggacccagcgtgctgcgggctgagtgggaaggggtggactgtctttgtgcagaggactctgtgggactgagaggaaaggggtggactgtttctgtgctgaggcaaggaataaagtcagaagtgcctttgtgaatagaatttggaaggtggaggccgggtgcagtggctcacacctgtaatccca

SEQ ID NO: 5893 - DNA, 251 bp, Homo sapiens
  ENST00000592550
caagatggctttaatggtgacctgccacctctgacccttgaccgctggcatcccccatttttcccccactctgcagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctg

SEQ ID NO: 5894 - DNA, 1391 bp, Homo sapiens
  ENST00000590680
tgtacccgcacagcctcaacttcagcagccgccagggctccgtgcgcaaccttgctgtgcgagtgcagtacatgacaggcgaggaccccagccaggctctgccggtcatctttggcaagtccagctgcagtgaatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaaggccatcgactgcaactctagccgagcctcctcctacctcgagggttcctcctcggccccaccagccacccagctgagacccactgtgcagaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaag

SEQ ID NO: 5895 - DNA, 231 bp, Homo sapiens
  ENST00000590452
caccagccacccagctgagacccactgtgcagaagctgcttcacgaggagctggctctgcagtgggtggtcagcagcagtgccgtacgcgaggccatcctccagcacgcctggttcttcttccagctcatggtgagaccccctcctccctgcctggtggcaagagacccccagtggagccccttccttttttaaagagagaagccccctggccaggcatagtggctcacac

SEQ ID NO: 5896 - DNA, 554 bp, Homo sapiens
  ENST00000585904
ctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagggcatcgatcgctcacactcctgggtgaattccgcttatgctccaggaggcagtaaggctgtgctgcggcgggcgcccccttattgtggggccgaccccagacaggccatcgactgcaactctagccgagcctcctcctacctcgagggttcctcctcggccccaccagccacccagctgagacccactgtgcagaagctgcttcacgaggagctggctctgcagtgggtggt

SEQ ID NO: 5897 - DNA, 3023 bp, Homo sapiens
  ENST00000591750
ggtgcaattattgtcattgttgttatttatcatcatcagtatcattacaaaggctcagctggaaggcctgaagtgcccattatacacatagggaaactgaggcccagagaggggtcaaggcttgcacagagttgcccctgggggaaggaggcaggactcggactctggcctcagtttccccacctgagaaacaggccacataactctagtgacctcctgggggaagggcagtcaggcccttgggtggggcttaggcttgaccactggccacctgaggtaccttggaactctggccctgagtgcctcgctattctctgccttctgtgtgtcactgtgccccatgagtgcctccaatgtccttctgtattcccaccctctaccacactgttcccaatctgtgtttttagggtgctcgcttgtcccccaccctctgccctctgtcctatctcctgactgatacctgtattacctctcaccgggccctcaatgccccagcctcatgacctactcttcctggactgtctgtgctcccagccagccttgtcccatcaccccagccttgtatgtgcaccttcagggcccctgtccctctgacacccccatcctgccccccacaggaacctgctgtacgtgtacccgcacagcctcaacttcagcagccgccagggctccgtgcgcaaccttgctgtgcgagtgcagtacatgacaggcgaggaccccagccaggctctgccggtcagtggctgtgccccagggaaggggggtagggcatcccccatgggtccctcatgaatccactctcccaggtcatctttggcaagtccagctgcagtgaatttacccgcgaggccttcacaccggtggtctaccataacaagtatgtagggggacacgtgaggaacttgggggcactcatgggggtaggaggatgtcccttatatatacacataaggcagcatcgatgggaagatgggggacaggaagaagagaggtagaggctcccagagtgctaatgagggaagctgaggcagacagcagagacagtggggcctagcagcaataagggcgtggcatggcagaggtgatggggcagacagtggggaccccagcccccagcagatcccccagcccgattctgccaggtcccccgagttctacgaggagttcaagctgcatcttccagcctgcgtgacagagaaccatcacctgctgttcaccttctaccatgtcagctgccagccccggccgggcactgccctggagacacccgtgggctttactgtgagccgtcccctccctccctccccctgagccctcctcgtcccccaacctggccgcagacctgacctccagcctctccccagtggatcccactgctgcagcacgggcgcctgaggaccggccccttctgtctcccagtgtctgtggaccagccgccgcccagctattccgtgctcacacccgatgtatgtgccctggagctcctgcctgccaatgcactgtccccagaagcactcccgagtcacctgccttccttcctgtcaatcctgggaggcttgttatcctctactggtgcctccagggcccccgtgtagctcattattcccctattaatgcctctctgtgtcctacatgtcctccccaaagattcccattgcctctctgctccattcccactttagccaccctgactgccttcctgatcactgtcccctgccctcgtagtaccttatcattccccatgaatgcaccattgttaatgaccctaggcctcaaatcctcctatcctgtttcctgacctactcaatgaatattcattcaccctgtgtctccattctctgcccccgtcttggcatgtggatttccagcctgcccagtggaccctctcagtctactgggaccagggctgggggcagggtgcttggctgcacccccagaccgggctacactcacgctgcagtgtcgcaatggctggggccgctgggtgacctgatcagtcagggagggctgaccagtgcccacctggtgcctccctcccacaggtggcgcttccgggcatgcgctgggtggacggtcacaagggcgtgttcagtgtggagctcacagccgtgtcctctgtgcacccccaggtacggggtgggccgggaaccaagagtcccgccctgctcccctcttgcctgccctacgattgagtaacagttgccgatggccggggaggtctggcctcaggccttggacgtgactttggtcagctggacccagctttaagggaagctgctgattcaggcaggggtggtcttcattccctgaggccccaccctgctcactccacatccctacccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattggtaagcgaatgtggcctcagacctcagtttccccatccacatggcttctcagtcctgaggtcctgagggatcttctataagcccatttacctctctggccatttttctcatctgaaaaatgacctccagtcccctgcacccagagaaggtcttctgtgaccctttggcccgggtgcagcggttcacgcctgtcatcccagcactttgggaggccgaggcgggcagatcacctgaggtcgagagtttgagaccagcctgaccaacatggagaaaccccttctctactaaaaatacaaaattagctgggcgtggtggcgcatgcctgtaatcccagctactcgggaggctgaggcaggagaattgcttgaacctgggaggcggaggtgacagtgagccgagatcatgccactggactccagcccgggcaacagagcaagactccatctc

SEQ ID NO: 5898 - DNA, 3152 bp, Homo sapiens
  ENST00000585609
ggggccggggcccggggcggcggcggcgggacgcgaggaccatggctgcctccgagcgccgcgccttcgcgcacaagatcaacaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgagtgggttcagccccacgccctctctgcctgtgattccactctgtctctgccaaccccatcaacagcccgacttcagctcctggcttggccgtgacgttggacaagccatgctttttctctgagcctccatctccccttgtctggaataggcaggacagtgctaaccttacaggctagcagaaggattcacagaggccttgtctctgtttaccctgatcttcttttgctgcagaaaactggatgcccaggtgagggccgcggtggagatgtatattgaggactgggtcattgtccacagaaggtgagtctgacttaggggcagctcagggggttcggaacccaaaagggctgagctgatgtctgcagccggtcctactgtgtatctgcccattgtccctgcaagagcaggcaaacttgtctggtggagcacaaggacggtggctttgaaggtgccatgtaggtgtgtcagaacacactggggaccccctgggggccctcagccctccctacctgcccagccccgtttcctgctaggtatcagtacctgagtgcagcatacagccccgtcaccacagacacacagcgggagcgacagaagggcctcccccgccaggtctttgagcaggatgcttctggagacgagaggtccggccctgaggactcggtgaggaagcccctggctggggtcactgaaggggtatgtgtggaggctccggcctcagcttttggtcacatgtgacaggaaatgacccaaacagccttgagctcaaaaggaattgcatcagtccccatgagtaaaaagttaggggtcataattataaacatttattgagtgcttagggtgtactgaaggcttcatatgtgtcctctgctttcatcctaggagtcagggcagccattacacccaggtaaggaaactgaggcacagcaaggttcttagaggccgtgagcctgtattttgtcaatcaacatttactgagcacctactgtataccaaccataattattccaaagattattgttgttttcattattattattattttaattaattaattattttgagatggaatctcactctgtcgcccaggctgaagtacagtggtgcaatctcagctcactgcaacctccacctcccggattcaagcgatcctcccacctcagcctcccgggtagctgggattacagacatgcgccaccatgccggctaattttgttattatttttagatgtacatagggaaactgaggcccttagagttgggggtcagagacccagtgtcacagagctgagctgggatttgatccagtgcaggaaggtcaggaagaactctctccttccctggcgacagtgaacaaagtcccagggaaggctttcattggcccagcccaggcccttggagccagtccctagggtgggtagatgtgttttgattgaccagataaggatcacctaaagccccaaatgtgggataaggagtagcctcccccagcaatggtaaaagttgggaggctctccagacagaagtttctggaaagagggtaggcaaaacccccaggtgacccttagagtgatgaccctcaccccctgaccctcaatttccccatctctagaatgagtatgaggacactctcaccagagtgaggtgaaggtgtatacagctggcactcagtgcttgcacattctccactggcagaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagtgagtatactgacatgtctctcttcttagatgcgtgaagcaaccacatgggttccggcggggtacacactacatgagtagtgccattaccgtgtgcggccctgtcacctatgtggccacctatgtatgggcttttatgggggaaggaagacttcctttttcattatcccgagtctccaatccttaagtgccaattgtatgccaggatcagttctcagcctttcatgtatatgaacccgtcttatattcaccacaacctcatgaagtgggcacaggtggggaaactgaggcacagagtggtgacatgacgccaagaccatacaacttgtaaggctggagtctggcgcttgcctgctctgctgctgggatccagggtttggccgggaggctttggggcgggtgctagtgaccctgggcctggctctcagccgcccagggcccctccacaccagcccccggggagcagcagaagtgcgtgggaacagagttgaacaggatgtggacttggacctgagcctggccctgccgctccccaccccgagttcttgcctggatcggggcaggaaagggaggctccattctggcctgaggcctgggtgggcctcctgccctaaacacaaggattgggacctggctctgtgggctcatccagtcattcaacaaacacttattggccgggcacggtggctcccacctgtaatcctaatactctgggaagccaaggcgggcggatcacctgagctcaggaatttgagaccagcctggccaacatggcaaaacaccatctctactgaaaaaaaaaaaaaaa

SEQ ID NO: 5899 - DNA, 352 bp, Homo sapiens
  ENST00000586482
ccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtgagtctgacttaggggcagctcagggggttcggaacccaaaagggctgagctgatgtctgcagccggtcctactgt

SEQ ID NO: 5900 - DNA, 487 bp, Homo sapiens
  ENST00000587572
agatgagggagcagaggccagggacccgtgggcctccctccagacctggaaggccacaggcccagccgggaggggaaggagagtccgtgatggcttcagaccccactggtggcagcattctcatctcctgatctgtgcttgatggggaacgcgttgggggaactggggagctgtgggcccttaaagcctcagcactcctggttctcttggccctcggcctatttatttcgttccacaatctggattttcctcatagaaagaatctgtccgctccgctgcctgagttttcccgtccccaatggccccctccctatctttccaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgg

SEQ ID NO: 5901 - DNA, 3678 bp, Homo sapiens
  ENST00000634495
gaccctgtcttttaaaaagaaagaaaaatatggacagcaaatatttactatgtagatgatattagatgtggtttctttttttcggactgggacataaaatggtcagatatgtccttctgataagaaatggagtacaatatatcttggaagaatgtgttttgtcagtaagccaccaacctgatttttatgctgaagtataaaggatatgcaagcatgcaaaaataattgcagtagaggatgaaatatagaggaaaacaacatagggaaggaggtaatcctcaaaagaatttcttgaggaaatttgtaagaattctcaagaaaacaccagagaagtggatgatagttcaggggttatgctaatgtcctggtgtttataccagtatatatagaatatggggaacataaagcttaattaagagcttgaggccgagcgtggtggctcatgtctgtaatcccagcactttgggaggctgaggcaggtgaatcacctaagcctgaccaacatggagaaaccctgtctgtactaaaaatacaaaattagccggacatggtggtaatcccagctacttgggaggctgaggcaggagaatcgcttgaacccgggaggcggaggttgtggtgagctaagattgcgccgttgcactctagcctgggcaacaagagtgagactttgtctcaaaaaaaaaaaaaaaaatgcttagagtcgggtgtcaaatatattagagtttaacttcccactccaccacttactaacagcgtgaccttgggcaagatacttttcctcctctataaaatgagggtgaaaataatttaatctatcacataaagttgtgataaggattgatataatacatgtaaagtggttaaccagtgtctagcacatagtaagtactcaaaaaatgttgaaagttgttatttttgttgttaatatgatttaatcataattactattagaaatcttaacactagttaataaaatctaagaggttttatatttcccagttgagatctgcatctagaagtgaactggtaaatgctctttaagaggaataaacctagtagaaggaaagaaagatcaccattgtgtgaaatactggtatgcctatatggaaatcagttaacttaaaggaagcattgtggaaaacaactgggagaggataaaagaagttagagaaatgatgtcactgtggaaatatacaactagtccatcggaatgtttcttgctaaataaagacaacaaaactaaaatagatttatgatatatttgtcataagaggtttgaaccatttagaaacatggtagatggatttcttcgtcccggacatagtcttatcacccagaggattgtggaagcagtaagtagaatcgctaaggaagaataagctgtattgtgaggagtgatagaaagttcagaaaggattcataacagtaaagaaaggtaatgctagaaaaacagcctaatttataggaaagttttttgtttttgttttttttttaattcaaaagaaaaacaggtatcatcctgtggtccaaagctctgaagaagaaataaagatgaagtgagtttttcctgcaggcgaagcaatatgactgtgcttccgtgaagcatacttccgtagtagtttgacactagagggagtgatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacaccaatgatagtagtaagaacttcatgattcttagcaactaaaatgaatgatttctctgtttcaaattaaaaccagccatcagtttttgacgatgtaaaccagtaaattagaatctacttaaagctatcttgtagcaccatgaaggtaacacagctggagtttgagaaattacctattttctgacacttgtaaagtttagaagcatataaaaagtaaaattaggtgctttaattcatctaaaattatatgcaagtcatacagaaaaaaaatttgagaagtaacattttaattcttggcaagtttttccaaaacgatgcatagtaatgatttccagaacagtttagaacaatggtttttgggtagtagtgcagtttacagaatggcatcatttataatccttttcttctactgaccagttacatgaatcactta

SEQ ID NO: 5902 - DNA, 7084 bp, Homo sapiens
  ENST00000251157
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacaccaa

SEQ ID NO: 5903 - DNA, 6985 bp, Homo sapiens
  ENST00000454575
ccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaa

SEQ ID NO: 5904 - DNA, 2221 bp, Homo sapiens
  ENST00000635348
ctttatgttccattttaaatttctggtaggggatatttgacctctttcatttaatcttgccagagcttagtttgtttttttagttttttcaaagaaccaacttttgcaatttttgatactctattttaaaatcttatttcctttctaatactttaagttgcttaactcttcagttttagccttctaatataagcatttgatgctatgtgttttctactaagcatcactttagtggcattccacaaatatgtagagatatatatattatttgtaaatatcctttccttcattgtctgtcagggtccagatacttttctcaaatacttgaattaacttggataaaggactgtcatcaaaatctattcatttagccgggcacggtggctcacgcctgtaatcccagcacttagggaggccaaggcgggtggatcacgaggtcaggagttcgagaccagcctggctaagatggtgaaacccgtctctactaaaaataaggaaaattagctgggcgtggtggcaggcgcctgtaatcccagctacccaggaggttgaggtaggagaatcgcttgaacctgggaggcagaggttgcagtgagccgagatcgcgccactgcactccagcctgcgctacagagtgagactccatctcaaaaaaaaaaaaaaacaaaacctattaagaaatatttgaacacaggcagacactgtgccagatgacattggtgccacataaatgagcatgattacatccctgaaagagcttctagtcaagtggtgatgtgaaaaaaatgccttcagataattttcaatttaatgacactggaagtaaatagtagattttacaggaactcagttgattatctgttccctgccttaaacctaaaacaaaagatgattatttaacattcagctgaaaaactaaatgtcctcatcatggtgaatacacacacatttgtttcagatagtcccactcggttgcccaggctggagtgcagtgatgcaatctcagcgcgcgcgtacacacacacacacacacacacacacacccacgtttgagacagtcccactctgttgccctggctggattgcagtggtacaatctcagctcactgcattctccacttcctgggctgaagcatcctcccacttcagcctcatgaatagctggggctacaggagtgcaccaccatgcctggctaatttttgcatttttttgtagagacgaggttttgccatgttgtccagactggtctcagaactcctgggctcaagtggtccacctgccttgacctcccaaagtgctgggattacagccatgagccaccatgcctggcctatatttttgtgtgtatgtgtgtgtgattaggcccacatatatagtctgtgttgtgtgtcattaagcccacatatatatgtatatgtattttgcgtgtgtatggcattaaacccacaaactatgccagaagtaatatcttgataacatcctgtttttcctaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagcccc

SEQ ID NO: 5905 - DNA, 6506 bp, Homo sapiens
  ENST00000635983
ggatttgtatgaatcatttctattgctgccaccccttaaaggaacccatacatgcagtctgccttcaaacctagaaaccactttatcagcctagacataacatgcttggacaaagtacatatcatttctgttcttaaggagcttatatacttgtggtcctaagtgttatggaaaggaacaaagcaaaagaaaaggaaaaggaggtattggagagtgggaggcctttctaaggaggcgataaaggaaaatttgtgagaagaacaattaggaaaaaggaacaacaaccattgcacaggttgtaagtcagaagcgtagtcagagtatatactgatagattcgcaaggataacagaaagcggtaagcaagaggaagaatggtaggaaataaagtcatatcatgtaaggccttataagccatggttaagattttaagcaaaccaatgttagaacatttgcttatttaagtgggtattgttttaaagaaaagatactgcatatagcaagtacatttcttctgaaattattgtgaaaatttttaataaaaagcaccattgtcaggtttttcaacttgtactgaggataaaatggcttgtacaaattattgttgtatatttcttacatgattgcaagtatacatatatgtggtccaactgaaataacatttgaaaattggttttgaaatttatttgacagagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggtaatgattccaatttctagcttcactataaagggaaaaaactgtctgaaagcattaatgttgttttgcactgatgtcaaactagatcccgtgaaatgaccattttaatcagactacaaatgagcggtcaaaatgatagttcatggccaaagcaaagctcattaacaataaaaatgaattcacctaaagtaaatggtgatcatcataaactttctgcatagcttttttttttcatttttgaattattaattagcaagtttttaaaaattgtgattttctgtttcacaaggtagatcatagttgtgaatctcattttaaaattgatacctattcctttgctgtgaaaatgaagtttttatatttcagttttttaaattaaatgatgtgaaactttaataattaaactactaatatttttaatgactgcaactgaactttatttttcctagatgtttacaatcatcctttgatatatttctaatacaaaaatattattttgtgaaaataatgaataaaatggttgtcttaatgtatatttaattctaatagtatttcattacttaatctttgtagttcattatggaatctacatattatcactaaaattagcatcaaattaaacttaattttaaaatgaagtacactactagcagttgatttctttgaaactaaatccttggcttcattgaaatactgcaaaatatcctatcgagtctcctcctcctccacttttctgttcccttccccgtgctaccctactgttacctactgctgctagtgtcaaaggagttggagtatgactatccacttttgtattcagtattagtcctactttgttacctatcagcttgacctcttcttttttgcaatgaattaagctgttctaaatgaactgattaatctgaaaagcctttgacagtctaaaaatagggctgctatcctgttaagtcaggattttattgtcatctattaaaatgttaaagttgaaaaatattgattaggtttcatgaccatgacaggtaggtcttttaataatcagttgtatatatactatcacaggaacctcaagccagtttctagagctgtaaattgcaaattataaatgttaggtctggaacatttagagctagtcgtttctgagaaacttttagccatttgtgtcgttggcatttgagcagagttgcagtttgtattttaatttatcctggatacttggtgaagtgcagctcaccttagttagagatcttacttaaacatgtaaatggaacaagctgctggctctctttccctaaaatttgtactttcacttaaagtttttaaaaggcaaaattttagccactgggttttgaccaagcaatttatgaaattattgcaggtcttaagtaaatgaatatgctgtttaaaatatcctgctgtcttctgtttgtggagaagaatttatggtatatggtgcctttggccttttttgttctttcaaacagtttttttatgacttgcccttttttactttttattatacagagtactggctgggaggtaggtaatgttttagttagttaaagacactaatagattgattttatcagatttcttatgccaatgctttgcccacatgtgctagctgtgggcattctgttgctatctgctatcaactgaattcattaaccaaagaaattttgttaaaatattgtaagttattttaagaaatatcttattatgaggtcgtaggcagtgcatggaaatccatatgttacactaatgagattctttggtaaatgagccactttgtcatcactttagtttttaccctttgaagcatttctctcatcaacatttatacacagatttctttttttaaccatattgtttcacctcattttacagaggtcgatttatgtgttattgctcagaggtgtaaataaaaaatactctatttcatctgatctcagatggcatcaattacaaaacatactagtattttatatgcctttaagaaaggaaaaaaaaaatccctgtgtattaaaccaggatatcctattagttgaaagatgaataccaactacaaaaacattaaaatgtgagcaaaaaaagtacattttagaattgatgagatactgtgttaatttgatcttgagtcacttcaccttgactatgagcactactgaggaaagaaattcacttttgtcatttaatttttgttggggaaagggataaagaaattaagagaacttataatttaatttgacctcgtattctgacagcatttgatatattgtttgataagactacacatgcttccttttatgtagtagttaagactcacaaaaagttatatgtaaatacaatcttacccgaaaaaaatgccaggaagaattgattaccattattttaaacgtttctgcaaaggaaataattctataaaatatgccctaatttattttgatgaggtaaagcaaggtagtaataagtcaggtttatttaaagctaggtatatttgtaaagttgtgtgctttgcctctcacttgttgtcagatttatgttgatcgaacacttaggcttctctttttgggtttgcattgcaatccttgttttaagacccaaatagaaaaccttgggaataaatattactactgagttttcctctatttctgaaatagtacccaagtcttgtttttctttagatgaagccagtacttttataaatctaccttaattctctagattaaatgtatatgactgtatcaatactcaaaatataatcctcattcctatggctcagttaagacatacataaagagacttgccatggttatctatgaatgataaaactccttataaatttcctaacattaaatagaattagttgaaaattaggcataaaataataaattgaaacctctgagcagtttattactagtttccgtgatgctaaatcgacccctgaaaggtataattttcactggttatgacattaatatcattctgtcatcatgtttattgcatggtaaaagtctcacagactttattttcttgttatatacttgtcactaccttttactggacctttagctttgtagctgctaaatttgttgcacgtttgttttttgcttttcctttgtaaaacttaaatggatgcctgcatttaaaaaatgtgttttctaccatttgctgcttatttgttttgaaatttctgtaattaaaatgctttctgttttctcttctctcttgtccctggttgctgaccctactccccacttttactattgtctattgtggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaat

SEQ ID NO: 5906 - DNA, 6731 bp, Homo sapiens
  ENST00000340370
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcggtacgtacacaatagcttctcctcctgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 5907 - DNA, 4071 bp, Homo sapiens
  ENST00000637255
gatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagggaaaggaagatgagttagaaaaattgtcactcttactttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactatta

SEQ ID NO: 5908 - DNA, 6303 bp, Homo sapiens
  ENST00000634264
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaa

SEQ ID NO: 5909 - DNA, 6297 bp, Homo sapiens
  ENST00000635123
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaa

SEQ ID NO: 5910 - DNA, 6423 bp, Homo sapiens
  ENST00000635253
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcggtacgtacacaatagcttctcctcctgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaa

SEQ ID NO: 5911 - DNA, 100 bp, Homo sapiens
  ENST00000637306
tgacccaaagctcttcagacatcataataaactgcgactctgctttaaagattttactaaaaggaattaataaacttggccagtgtggtaccttatgcct

SEQ ID NO: 5912 - DNA, 1855 bp, Homo sapiens
  ENST00000489185
ctgaggtgacacttttttaaaaaaaattgtaaaaattgcatagaaagtgtccaaatatttatctttattgaaagaatttgtcttctgatatgctgtgtgagagttaaggtgatcttaatgtactttgtacctgacatgaatgtgtagttaatgcatgccaatgggtggtttgggtgatttagaataaccaactcatctcaaaaattttttacttattatctttcactcatagatttttttttccttttctgttccatttttagtaactcttctacataaaaattttttactgggctgggtgcggtggctcacgcctataatctcagcactttgggaggctgaggtgggtagatcacctgaggccaggagtttgagaacagcctagccaacatgctgaaacccgtctctactaaaaatacaaaaattagccaggtgtggtggcatatgcctgtaatcccagctactcgggaggctgaggcaggagaatcacttgaacttgggaggtagaggttgcagtgagccaagattgtgccactgcactccagcctgggcaaaagagtgagacgccatctaaataataataataataataatttattggcacagggctgctaattgtagaatttttgcattagtgcttctggagggtcttgacatttacattgcctgctctatgccaggtgctatctttgactcctaacttttacaatctcatttaatacgtgaagaggttatataaaggctaatgctaatttaaaaatatgtaagtgttgttttaaaatttaacttgacctagtatgctctagtatcagtacaattaagacagtttatatcaagcatcttttcttgcaataaggaaaatgagttaatttatctcagttatatagatttaaaaaacatagaccaatgtgatagaggcacttcgtacaaactccgaaaaatattatatgtgatttagtcacttgttagtagccctatttgcatacttatttgttagaaataatgaaaaaggaaagactgtttactttgtttaaaccttcatttaaaatattataattttgaattaaaactttttgcaatgttttggaaattttatgctgtaacaatctaaacataatgtgaaaaacaggaagatttcatattaaagtttctccattttcctaaacctaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgc

SEQ ID NO: 5913 - DNA, 855 bp, Homo sapiens
  ENST00000467758
ttcatataaaatgtttctttttctttattgtagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagaggtaagtccattaatgggcaaacagcattagtgaagcaaatacattcaagccatgtaacaacaactcagatgtaccagaagatatgtaccatcccttataccataacatattagaactttacccatttttgagtcctcaattttttacttcttttctaagaccctaattcacccccagctttttctttaaaaggttgattttttttttttcatttaggaatccaagtttggaattttattgttacatgaaagtttacaattgatcttttttttttctaatttcagttgattatacataaagttcattaaatagttttcagtcagtacactgatttaacagatgctcttttactcagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaa

SEQ ID NO: 5914 - DNA, 123 bp, Homo sapiens
  ENST00000637487
ctgtgaatcaaagtctgcattttaacaagatccccagggattttacggagaaagatttggagaggatgtggttgaagtaatcaaagactctaatcctgtagacaagtgtaaattagatcctaa

SEQ ID NO: 5915 - DNA, 382 bp, Homo sapiens
  ENST00000635088
tttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagtttttttatgacttgcccttttttactttttattatacagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacgga

SEQ ID NO: 5916 - DNA, 126 bp, Homo sapiens
  ENST00000637839
caagaatttgtttacaaggagcctgcaataaccaaacttgcagagatatctcacagattggagtgtagtggatggaccggaagcattgggttcacctgggagattgtttgaaatgcagaacctcag

SEQ ID NO: 5917 - DNA, 100 bp, Homo sapiens
  ENST00000638042
agaagaaataaagatgaagatggtaagcggatgtttggcacctattttcgtgttggtttttatggaaccaagttcggggatttggatgaacaagaatttg

SEQ ID NO: 5918 - DNA, 117 bp, Homo sapiens
  ENST00000636370
tttttcctgcaggcgaagcaatatgactgtgcttccgtgaagcatacttccgtagtagtttgacactagagggagttaactcttctacataaaaattttttactgggctgggtgcgg

SEQ ID NO: 5919 - DNA, 100 bp, Homo sapiens
  ENST00000636746
agtattctggtagatctttcactggattgaagtccaaaaaacaggtatcatcctgtggtccaaagctctgaagaagaaataaagatgaagtgagtttttc

SEQ ID NO: 5920 - DNA, 100 bp, Homo sapiens
  ENST00000637735
gctgaccctactccccacttttactattgtctattgtgaaaaacaggtatcatcctgtggtccaaagctctgaagaagaaataaagatgaagtgagtttt

SEQ ID NO: 5921 - DNA, 8283 bp, Homo sapiens
  ENST00000637208
acgagcgaggaggcacgcgcccgccggtccgcacccggcccgccgcagccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagttctatcttgtgtatatttttctttttgactcgatgaaaacttcagtaattttgttttttctaaaagcaatgtttcctagctaattttctagtattctggtagatctttcactggattgaagtccagtaaggataatctgtgcattgtagaaaggctctttgaattgataacttgctccccaacttacaggaaaaccccatctgggcttatatattagtcacatgtttcatttttttattgtgctccttgatttagtgcaaattatttgagttggcaaagctttttagaagggtgtgtgtgtgtgtgtgtgaaagataactctaaaacttagtatttcagtaaagtctttaccatgcaaaataataaatcatgaacctttcgggagtcatgtggctgttatctcctctggtagtttcagttctttaatggctgtttagtgttcacttttatttttacttttccctcgaaatagtaggaagtaaaagcatgtttgttgtcttttaaaatttttgtttatgagatggggtctcactctgtaattcagactggagtgcagtggcacgatcacagctcactgcagccttgacacctcctgagttcaggtgatcttcccacctcagcctcccgagtagctaggactgtaggcgcatgccaccagctaattttttgtatttttgtagagacagggttgtgccatgttgctcaggttgatctcaaactcctggccccaagcaatccacctgcctcagcctcccaaagtgctaggattataggaataagccaccatgcccagcctaaaagcatgttttgaactcttctttttttatgattcatatttaattatttttagcagaaagagaaatgttaaatttctgtatgaaaatttttataaccactttctatgttatgtatgtatatatacatatatatttttgtaattatgtttgtaccagcctggacaacatagtgagaccatctctacagaaaattagaaaaattggccaggtatggtgttgtgcatatgtactcccagctactcgggaggcagaggcaggaggattgcttcaccccaggcatcaaggctgcagtgagctatgatggtgccattgcactctagcctggatgacagagtgagaccctatcttagggtcagggttaaaaaagaaaagtttgttcagttatcaaatagtgacgaatttgtattcagaagtacactaatacaagtttaaatttttcagaaaaatcaatccccagtgataacatagtcatgtgatacttttttttccattcaaagatcacaacatatttctttaaagaacaccactactctagtaaagtatatcttacattttctggaaaggctagagaagatctctactagatccctaaggaaatatagattaccctaacttttgagattgacagatgcaaattgactatatcttaactctcattattggactgaatggacatgaatgtgagccagtattttggtttttatatgttcagaaatactggccatagttctggctcagtggcttctgttggatttttattttcttcaatccacactaaagctgagtgacataaagtaacacatccaagcagttaaaagatagaacaggattagaaacagcaaattataatgagcagggcgatcaactctgaaagagggaaatgaaataaaaattcaagaatagagcatagtgaaaacaagtacttttgggtagtcaagtgggtaaatgtgacactctaaaggagaaagtaaaacaggtcaggcacagtggcccacacctgtaatcccagcactttgggaggccaaggtgggaggatcgctttagttcaggagtttaagaccagcatggtcaacatggcaaaacccatgtctctaccaaaaagaaacaaaaaaaattgctggggcatgtacctgtggtctcagctacttggaaggctgaggtgggaggattgcttgagccgggaaggtagagtttgcagtgcgctgagaccatgctactatgctccagcctgggcaacaaaacgagaccctgtctcaaaaaaaaaaaaaagaaatcagaacattgtaggtataaaacatccatgagcctttacctcagaaaggtaaagttagatatgaagaaagttaaggaaaacatagtaaatgggaagaatcttagtatctctaagaggagatactttctggtagttagtgactccctgatgactggtatagacccataactgagcacctgataatatatcccataccactgattttttttctgccccttatgctacttttgagaagaaaaagaaagatatgaaagcccagcatggtggctgacacctgtaatcccaacattatgggaggccaaggcgcgatcctcgcttgaggcctgaagtttgaaaccagtctgggcaacactgagatctcatctctacccaaaaaaaaaaaaaaaaaaaaaaaaaaaaaaaaaaaaattagctgggcatggtggtgtgtacctgtggtcctagctacttgggagactgaagcaggaagatcacttaggcccaagagtttgaggttacagtgaactatgatcaccactgcactctagcctgggtgacatagtaagaccctgtcttttaaaaagaaagaaaaatatggacagcaaatatttactatgtagatgatattagatgtggtttctttttttcggactgggacataaaatggtcagatatgtccttctgataagaaatggagtacaatatatcttggaagaatgtgttttgtcagtaagccaccaacc

SEQ ID NO: 5922 - DNA, 1566 bp, Homo sapiens
  ENST00000479983
ttctaatggtagattgaaagtccaaatgcactttttccaggtggcatctttggatcttctgtgtctcttcttttaagaacaatgcaaatgtacttattgattatcaaaaacgaggatttttttaagtattcataacacacatttaacaccttggtgtcctgggccccagagttcctttgaaggcccataccaatattttcagtgtaaaactcagtcttttcagaagaaaatacagtatatgaatgttttacgataacattaattacctgattttcaatacagttatgactgaagaatgatatttctaagggcacattttgaaaactccataaatcgtattgtattaacaccttaatagatacaatagtaaaacttaagaatttttctctgtcatatgaccctctgttcctgcagttttggggttcattaaaagcacaaataaaacaatttaatctctttgaaataaagtaataaaagtaccttttagaagttttctttttcccttgtgtataaaacttctctatgtttctgtaatgaacacataaatttccatactttttcccttaactggttattttcttaaaagtcagaatttaatatggcgtatttcttttttgcccctcctgccccccccaccaactgatattatccattccataggccacagttatttctctaggcctgcatagcgacattttcatactactttaaaactaagtaggttgtgcacagtatcaaaaacctttctaggtaaactctgagcgagctatctaaactccctcccagcttgggaagcacatactaatggagaagaatttctgttctaattagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggtagatgactcttgttaattcttttcccacagtttcatacctctaattatcaatgacatgtgtatttattctctctggcttatgaccctacttttctttaaagataatttattctggacccagtatggtggctcatgcctgtaatctcagcactttgagaggctaagacgggaggattgcttgaatccaggagttcaagaccagcatggggaacatagtgagataccgtctctacaaaaaattaaaaattcaccaggcatggtggctcatgcctgtggtcccagctacttgagaggctgaggtgggaggattgcttgagcccaagaggttgaggctgcagtgagccatgattatgctgctgcactccagcctggacaacagagtaaaaccctgtctcc

SEQ ID NO: 5923 - DNA, 100 bp, Homo sapiens
  ENST00000637144
gaagaagatctggaattgagggaaacaacatttcctgatcaggtgaaagaacaaaaataaacatagtctgctgaggaatttatataaagtttactaccct

SEQ ID NO: 5924 - DNA, 580 bp, Homo sapiens
  ENST00000635286
gtggaagaattttaggagaaggggcagacatggcaagtgagagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaaga

SEQ ID NO: 5925 - DNA, 765 bp, Homo sapiens
  ENST00000634929
acaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctc

SEQ ID NO: 5926 - DNA, 745 bp, Homo sapiens
  ENST00000634652
tcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacagctttttcacgaggagctggctttgcagtgggttgtttgcagtggcagcgttcgggaatcagctttgc

SEQ ID NO: 5927 - DNA, 275 bp, Homo sapiens
  ENST00000635027
cctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaaggtagattcatatgaaga

SEQ ID NO: 5928 - DNA, 100 bp, Homo sapiens
  ENST00000637431
tgcatcatatattcattatgttttccgcctaccaaatacttaccctaattcatcatcaccagagtgctgttgggcattaaaggagaaatgtggtggctcg

SEQ ID NO: 5929 - DNA, 681 bp, Homo sapiens
  ENST00000634223
cactacttacagaaatcttctctacatataccctcagagtcttaattttgccaatcgtcaaggttctgctagaaatataacagtgaaagtccagtttatgtatggagaggatccaagcaatgccatgccggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctg

SEQ ID NO: 5930 - DNA, 2678 bp, Homo sapiens
  ENST00000404627
ggcggaggccgcgagggagggagcacgagcgaggaggcacgcgcccgccggtccgcacccggcccgccgcagccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccgagccccagctgcacccatcctataccgacagttagacctctccctctttggtgctaccatagcatcttctcacttctttcatgggactttatcacttgatgattctatatttcttaatttcacccattagattgtgagctccttgagggcagggacgatgtcttactcatgtctatatcttgactcctgtcacatttttggataaataattaatgctcaatccatattgctaaatgattaaaagtacatgtcaaatggtcaaaaaaggaacactgtctgctttatgtcatattatgaaaataaacaagttattttgtgaaaagtgatagcttctcagagggaaaaaaggtattgcatttcttttacttgtgtgttattagtcatatgaaaatacaatgtttttatgtatgaaatggctgatttgaaagagtatataaacatagacatactgtgtttgccttttttaaaaaaagggctgtttaaatgggtcctaagataactttttgataatgtaatattgacatgataaaattgtaaacttcataattctggcacaggaacaatttatgaaaacatactaaggtatttgtaaattgatgaaataatatatatcttaggaaagtcataattattacacttgtacatacccttaaaataaaagagcctgcttgaaatgttgcaaaaagaaacagaaatacctgctaatatgcccttctaattaaggatgatgccaattaatctctttatataaataataaactttgagttgtttta

SEQ ID NO: 5931 - DNA, 1982 bp, Homo sapiens
  ENST00000614472
ccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagttctcaggcttgggcttccattactatgcctaatagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccgagccccagctgcacccatcctataccgacagttagacctctccctctttggtgctaccatagcatcttctcacttctttcatgggactttatcacttgatgattctatatttcttaatttcacccattagattgtgagctccttgagggcagggacgatgtcttactcatgtctatatcttgactcctgtcacatttttggataaataattaatgctcaatccatattgctaaatgattaaaagtacatgtcaaatggtcaaaaaaggaacactgtctgctttatgtcatattatgaaaataaacaagttattttgtgaaaagtgatagcttctcagagggaaaaaaggtattgcatttcttttacttgtgtgttattagtcatatgaaaatacaatgtttttatgtatgaaatggctgatttgaaagagtatataaacatagacatactgtgtttgccttttttaaaaaaagggc

SEQ ID NO: 5932 - DNA, 100 bp, Homo sapiens
  ENST00000637227
ccctgacagtagagttagacctaccagagaaatcttagagtttcccgcaagggatgtttatgttccaaacactacttacagcaacgtggaactgttttct

SEQ ID NO: 5933 - DNA, 519 bp, Homo sapiens
  ENST00000464312
agagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggtattgttctgtcatgtaggaattttggggagatgtttgtgcataaatttttttaatttcagaaaggtagtgattgtactatacatgtatgggagggtgattccaagaaacttaaaaactttaagaataaaaataataaaagcaactataagaatgagaaa

SEQ ID NO: 5934 - DNA, 3335 bp, Homo sapiens
  ENST00000635827
gcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagggttctgcaaccactgctacagaatacttctgtatccatcttggaacacttttgtacccattagcagtggtcactcctcattcccccagagtcttgcaacctgtccctaaacaacctttaatatatattctgtctctatagatttgtctatgccagacatttcatacatattgacttgtataatatgtagtcttttgtggctagcttctttcacttgccataatgtttttcaggttcatccatgtcgtagcatgtattggtattatttatttttattgccaaatgatagtctgttgtattgatatactatatttatttatcagttgatttgggttttctacttttagtttattatgcataatgtttcatagtgttgaaacgtcatttacaagctttcgtgtggacattttttttccttagatatgtagatatatagctaggagtgaaattgctgggtcatatgataattctgtgcttaatcttttgaaggactgccacactgttttccaatttggctgcaccttcaaaaattccactagcattccactagtgtgtgaaggttccagtttcagcatatctttaccagtgtaacatattatctgctctttgattgtagtcattctagtgcaagtgaagtggtactcattgtaggttggatttaccttttcttaaaagctagcgatattaagcatcattttgtgtgtattggctatttgtgtatctttcttggagtaataggtatttttaacctttgctcattttttaatggctttggtctttttattatttattaatagttgatgcctattttttaaatggggttttaaccttcttggcattgagttgtaggagttctttatatgttcaagatgcaaattccttgcctaatatatgatagcaaattttctcctagtctgtgagttcacttttcttgatggtattgttcgtagcacagaagttttaaattttgaggaagttacatttttctatttttttcttttgtcactgtgcttttggtgttttatctaagaaaccattatgtaatatgaatcaaaatttacttgtatgtattcttgtaagagttttatagtttcagctgttacatttaggtttataataatccattttgagttaatatttgtatgttgtgaggtagtccaatttcattctttttatgtggatatccagttgtttcagcaccatttattaaaaaggctattcttttcccattgaattttcttagatcccttattgaaagtcaattgaccattcatgtgggatttatttctggactctccatcccattccactgatctgtatgccagtgctttactgcaggggttcctaatccccaggtggcggacaggtacctgtcctgcctgttaggatccgggccgtagagcagtaggtgagcagcagctgagctagcattatcgcctgagctctgcctcctctcagatcagtagtggcattagattctggtaggagcatgaaccctattgtgagctgcacatgcaggggatctaggttacgtgcaccttatgggactctaatgataaatgtaatgcgctttaatcatcctgaaacgatccccacaaccccatctgtggaaaaatttttttccatgaaaccagtccttggtgccagaaaggttggggaccgctgctataccaaattactttacctttgaaggctaagttttgaaattgagaagagtgggtcttccagcttttatcctgtttcaagatttgttttggcaattttgggtttcttttatttccatataaatttaggaccagctgtcagtttgtgcacaaaggcatctgggattttgatagggctgacattgaatctctaagtcaatttatagattgttgccattttaacaattttaaatctttgaatctatgaacatgaaatttttttcatttatttaaatctttttcatttttttcagtgttgtgtcattttcagtgtacaagtccttctcttgttaaatttataccgtagtattttatcgtttcttgataatattttaaatggaattgttttcttaattctgtctttagaaagtccatttctagtgtatagaaataaaattggcttttgtatatt

SEQ ID NO: 5935 - DNA, 1315 bp, Homo sapiens
  ENST00000634912
atttctttaatggaattctgctctagcaacttttatttgctaactcgaaactgctgggatattattcataaatttttttaaaagtcactttggaatccatcatctcaatgataatttctttgtatactttattagaggttacttttttttttttttgagattgagtcttgctcttttgccaggctggagtgtagtggcgcgatctcggctcactgcagcctctacctcccaggttcaagcgattcccctggctcagcctcccgagtagctgggactataggcgcctgccaccatgcccggctaattttttgtattttagtagagatggggtttccccattttggccaggatgatctcaatctcctgaccttgatcccctcacctctaattaaaagaatttggaatatggttgtttagaatatgcttattatgttttccaaatagcttgtttactttttttactttgatttaggtatgtaaagattggtctcagtgaaatataaactttacatgagagtataatatcctactatctgtagataaataagtaatttttttgagaattatttaacatgaatgtttttaaaaagaaaatagaaatttaatttattaagattaaatgttttcttattataattactgtaattgaaaacagattattgtttcattgaaagagttctaaaagtaagtagcagaagcagctttcttttaagaaatagacactgtaaaatgtacatattttaaagtttaacatactaatattttttagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaaggtgagaataatgttaaatatatttgtttattttgtagtgtctgtatacttgtctgtcagtattataaacttttcaagggcaaagatttgacctttacatatttttttcatcttgatattctttaacacaatattggacatacacagtaggtgctacctaatttttcttgaactctttattagaattctccagtgaaacagaactaataggaattatatatatatcttagatctgttttgattattgtagtttataaatacattttcatatcaggaagtatgagactttcaactttcttcttttttccctaaatttgttttgattattcagggtctcttgaatttccctatgaattctaggatgggtttttctatttctgcaaaaaaaaaaaaaaaa

SEQ ID NO: 5936 - DNA, 100 bp, Homo sapiens
  ENST00000636167
aaagacttcttgtaaaatgcttatcactcaaaaagaaaaatatttctttgacatgacacagaaagcactacccctagaagaaaacattgacacattttac

SEQ ID NO: 5937 - DNA, 122 bp, Homo sapiens
  ENST00000636635
gccgtcgccgcagcagccatggccgagcgccgcgccttcgcccagaagatcagcaggttcaaagtggacttgtgcgtccaggattgaaaacgtgtggacagaatgaaaagttgagagctgcg

SEQ ID NO: 5938 - DNA, 741 bp, Homo sapiens
  ENST00000469197
cagcgccgaccgacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactaagacggagtttctccatgttgtccaggctggtcttgaactcctgagcttcagtgatctgcctgccttggcctcccaaagtgctgggattacagagggacccttgtaaggactatagtcctctcttcagctgaccttcaggtccccagtcagaaccaagggaaccgactctgtcccttctcatagcacctgaaaaccccgggaaacgaggggaatgctttgctctcagctactgaggttgtcctgtcaccttctcttctgccctcctttgccatggcataggataatcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaagg

SEQ ID NO: 5939 - DNA, 2206 bp, Homo sapiens
  ENST00000524396
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacagtcatgctctgtcgcccaggctggagtacagtggggccatctcggctcactgcaacctctgcctcccggattcaagcgattctcctgcctcagcctcctgagtagctgagattacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctc

SEQ ID NO: 5940 - DNA, 7452 bp, Homo sapiens
  ENST00000432829
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 5941 - DNA, 2087 bp, Homo sapiens
  ENST00000454469
agacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctc

SEQ ID NO: 5942 - DNA, 595 bp, Homo sapiens
  ENST00000479404
cccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaagggtgataggcgcctgggtaaccgtgttgggcgcgccacggagtgtctcataaacggctccttcctttgaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccgg

SEQ ID NO: 5943 - DNA, 537 bp, Homo sapiens
  ENST00000487230
ttttgtctcctgtaacaatttacgcgccgtgtaactgtgaatctttcaaagctcttgcaggagaactctcttgtagctcaccctgtctgaaaacatactggaaaggaattcaaggaaatgtagttcagcctagccacgttgacacatcatgaagccgtcacaaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctca

SEQ ID NO: 5944 - DNA, 1873 bp, Homo sapiens
  ENST00000382341
ttttgtctcctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctc

SEQ ID NO: 5945 - DNA, 4788 bp, Homo sapiens
  ENST00000483757
ctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatata

SEQ ID NO: 5946 - DNA, 1395 bp, Homo sapiens
  ENST00000478380
aatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggtgggtgccactgtttccatactggagaatctcagtgaagactctgagagtcatgtggacaattgtgttgttcattattactatatagcagcccatggtgtcagggctcacttgtatgatttctggggcctcgtttttcactcaggcaagcctgtgtgtcatagcagagccattattgattatcacacagatgggattctgataataataacaactggaattttcatagcactttacaaaatatgttcactaagagcatctcatttaatccccaaatgtttcaagggtctacatgtagtaatcacacccagcaagtcaaaccatcctattatttgaggggatgtgtggtcactaatccattgagacatacattacttaaactttgatgttctttagtgctttgttactttctttttaatggtctctatgagcaaccagagagacctgctttgaaaacatttcaggctaggataatcacagcccatgctcccaatgtatagaactttgggatcttgattgtttacttcttcatttattggagctgactgacaacaataggataatgtagactttgcctgtggtcactgcctgaggcactttggatgaaatgagaggtgacgattattcaagccttttgtctgtttgaactccttatactgtataggaggctctcagttttcccctctgcgtgaggttatctacacttctgggtcttgccagaacagattactgctatatctctgctgtccaaatggtattgaaagttcagttggaa

SEQ ID NO: 5947 - DNA, 6386 bp, Homo sapiens
  ENST00000469391
tacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggcca

SEQ ID NO: 5948 - DNA, 9277 bp, Homo sapiens
  ENST00000495184
ctgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggaccacagtgctgatgaatacaaagtaccgcctagtaattataaacacacaccacctccacaccttctaggagtggatctttgttctgaggcaaaatataaatcaaattattcatatatatatatatatataaaatgcagtgtgctccaaggaactcaaaatgccagaatttatactttttaaaccatctcctactaaatgagatggtggttagctattactatttcccataagtcatagaattcagttaatataactttctttctttttttcttttttttttttttttttgagacagagtttcactctttttgcccaggctggagtacaatggccgcaacctccacctcccaagttcaagtgattctcctgcctcagccttccaagtagctgggattacaggcgcgtgccaccacgcccagctaattttgtatttttagtagagatggggtttcaccatgttggccagggtggtctcaaactcctgacctcagctgatccacccgccttggcctcctaaagtgctgggactaaaggcgtgagccactgcacgcagttaatatacctttctaaaaagaaaaagaaaaaaatcctttctcttaatgtcccacccaaagaaaaaaagaaaaaaaaaaacctttctcctaacgtcccacctgtcttcccaatgcaaggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtgagtgcacttgttcataatgcatcctaaatgctgcttcaggcccaaggaggtatctttttctaaatggcacaaatgtggataaggcagtggagattcaaatcacctaagtgagtaggtctgtatgtttgagagagaagaacctggaactggggatttctcactcaagacaaaagtatgtaactttggcctgttggatagacctctaggcagtgaggcagagtggagagagtactggttttctaatctcacaaacatgtggcctttggtcactaatatagccccttggaacctcatttcacccttcatagccagttcctttgcactggtgtgcttgggccagttgtagtcccagcacttttttttttctttttgagacaggatctcactcttgcccaggctggggtgcaatggtgcaatctcgactcactgcaacctctgcttcctaggctcaagcgatcctcttgcctccgccccctgagtagcagggactatacgcatgtgccaccacgcctggctaatttttgtatttttttgtagagatgaggtttcgccatgttgcccaggctggtctccaactcctgggctcaagccattctcccacgccgacctcccagagtgctgagattacaggtgtgagccactgctcctggccaacccagcactcttaattgtacaaaatgcagctctatgagaccagaacatcctgttggcctgatgatagtcaatttgatgtacccaaatgttactgataatttgatcctttctctactggtgaacaggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataag

SEQ ID NO: 5949 - DNA, 384 bp, Homo sapiens
  ENST00000474772
gcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacgta

SEQ ID NO: 5950 - DNA, 1922 bp, Homo sapiens
  ENST00000382331
gagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaa

SEQ ID NO: 5951 - DNA, 6124 bp, Homo sapiens
  ENST00000382329
agaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 5952 - DNA, 535 bp, Homo sapiens
  ENST00000493666
acactgctcctaagacagaggtactcagatacgtggctgaaagcctagctcaaatactgccccagccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcat

SEQ ID NO: 5953 - DNA, 428 bp, Homo sapiens
  ENST00000462618
cggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctgaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgc

SEQ ID NO: 5954 - DNA, 7237 bp, Homo sapiens
  ENST00000453981
cattttgtctcctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 5955 - DNA, 8890 bp, Homo sapiens
  ENST00000382713
gttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttgggattttcagacgatgctggttggttttcaagaaggcttctagcaaaggacccagaaggttagaaaaatttccagatgaaaaggcagcttatttcagaaactttcataaggtaactgaactgcacaatatcaaaaatataaccagactgccccgagagacaaagaagcatgcggtggcaatcatctttcacgatgaaacatcgaagacatttgcctgtgagtcagagctggaggccgaggagtggtgcaagcacctctgcatggagtgtctggggaccaggctcaatgatatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggtcatgggtttggttcgtcaaagatgtctcgtgcacagacatttcccagctacgccccagaacagagtgaagaggcccagcagccgttgtcgcggtccagcagctatggattcagctacagctccagcctcatccaatgacacacagagagccgctgttgactagagagacagtctgtcctggacccgtctgtggggtcattaccctctgcctcctggaagaccaattgcagtacaaattgaaatgggtcggctctagccccagtcccattggaaggttaaaaactggagttctgcttccttgattcagtggctaagtcctttatttattgaatttctttgggggaatctatgttttacataaatagaatccaaatcgtatgaacagttatttaaataaacaaaattctttgggtctgacagtaacagaaacctcagcactgggaaaagttgcccacactggggtatgcctgggtgatgggcacctctcactgacctcacagcgcagtccgcccatctgagcacagggtctgtccttagacataatggtgaccctccacaagctctgtggcttttaaagttctgacagggataaatacagtaagctctgcaaatgacatcgtagctgcatataaataaacccagtgacaattaaaggaacatgaaattcagaacacactattaagcagggccctgtagctctactcgtgtgtgtgtgtgcgtgtgtgtgtgtgtgtgtagacaaatggatattgctatatccatctatatataacaagtatatatcaaacatgtgctgagggtgacaggatatgctcacttaaattgttgaaaaccataatttggtgcattaaagttaagattgttatgttgaatagctatttttaaaatagtgctgtaaaaaaaaaaaaaaaaaaggcttcttattagcaaaagtatatgtaatccagtctgttcctaacaagtgtaagcaaaaatgtgagaaggggaacattcagaagcaaaagaaccagtctagctgtcctacacatcatgtcataccctgtctttctggtgagcgtttccttgttgctgacaatgttgctccctgtggccatccatctgagctacgtgaggaggattccatgtgaacgccgatcagcttccatttaaccttgagagaaaagagaggttctaaatgaagaactctttaagaaagaaagaatacacccataaagaactcagctattttgcagtaaagagaagaacaaaatgggtacaggattgtggatatcatagatgctgttctcacacaaccactgggggcttgtaatttactgtgtaaccagaacttgcagggctttattttttcttttactggacacaggttgtctgagattataagaaataaaatagatcaataattttcatcatccctgacactgattacaaacctacagtgtttaaagggaggtagtgaattccacggaaactgagtttggctaattcaggtcaacaaagatatatttgcccttaattctggagttaagtaaaaataaaaattatcctgcctgaatcatctgatgctttgtgcctaagatggttatctctcaaatactctagggtgggtttaaagaacagtgagctcaggtcacgcaagatgaaaacccaggttttttttttcttaataggaaaattttttaaactatccaaattagtctgttgaaagggtaccttttttgctgatctctgatgagttgtcttttcatccctatctgtagcttgagtgcagattgacaattcatttcagtgaattactaccgaataaaagtggttccggatccctcctagataaatgtgcacttacagcaactacctaggctctccaaatcactccactcggtatgaaaaccccatcaagatactaatcgtaagagttaatgtggctgcaaaaaataattatcctaagctttcagggataaaaagaaaattacccaggttctctgcactgtgaattttgctgacacagcggaggagcagatgactggttcctacaactgtacagccttccttgaaatcatagcttttggggttaaacacttgtgaatttcttttgcacatggcatttgcttttgaaatgcctttagtcaaatacaccagagcaactcccagctgagaccatttgagcacagttcctagtggggccacattcagagcaagcctctcgccggctcactcagttgagctgttgcttagacaccacaagtttctacaagggacttatggggaacggccctcaggggtcctggttcacatctcagctttattcatgtgctggaagcacaaacagcgagtccagggagggattctgctaatcagatgagtctgctcttgtgtctctttcttaggagacaaatacctgtatgtaattgcttcaagaactccatttggttctgatcattaccaatgaatataactgaaggagcaccaaagatcaggcataacctcgggccagttcattctgaaaatgatgtcgtaaaaagagtatgtgtgagagaaatctccttcccaagtttttaaccagatctcgtcacaatgaggagaatgctataatctatctcatggtacatttttggagcttaattctagcatactcctccaagtacactcacaattgtagctgagtcaagactgctaaatgaacagataggagaacttatattagactaatatccttgacacgaagcagggttcattgtaataaaaacggcaaacagataaatcttctaccaaaaccaaagatggaaagtcactgcaccagtctcctggaacttcataaaatcaatttcactggagcaaccagaagggtcatggagatgtataccactcgcttgggctcgtaggtttttgactggggatgcctctacactttgtaagtcatttctcccttcaaaaattgtattatatctttaatatatgtgtatttttcaatgcgagggaggaattactatgaaccaaagatatcttttggctccttctgaaagtgactcagtttgaattccattcagatttgtacagataaatagatggtcaccatttctgcatcaggttggaagagaccaatgataaaggaacccaacgtaaggaatagcagttctgaaaatagacaaagcctagaggaggtatctatttcactgagagattacacgaggggacttattttttatgttcccaattttttcttctgataatattaatcaatgtacacatgattgatgcatgatattacacttaaaatgcaggagagtacaaaacaaccttgatccaatagtttcctattctggggggtgggggcagaggcggaaaagaaaacacatctttcacttacttattgaacaaacaataagcactcagaactaatttatttatgcaggttgcaaatatgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtttattgcatgtcgtatctttattgtagatattaaaaacacatgataaaaattgatgtgtgcccctccttgtttggccagtatcacagaaaactttgtaaaaaagcatggggaccctactccctagattatttgagccatttactaaaattggccattagtgatacagtgaaaacaagctaaggaaatgatattctcctaaaaagttatattccagttttgattattataacacagcacaataaatgggcagtatacgtctaatggaactgagatttaaggctttaacaattcgtgttttaaaatattatattgaagactgcacaaagagaaaattatacatgtttctccaatcctgtgatcatgtctgtaaataccttgcaatttcaaattacttcatccgtcattaactatatgatctcccaaacacagccttctcaaaatcgataaaaatttgccactgaatatgcattaatagctataacaatgggtgacatgccacacaaatttagcttatgcaatttatggggtgtgtgtttgcagactatgaaatgtatgaagtgcagtctcccatggagagaatagagaggcaggatggcaactagtcatgaacgcaacaatttaggttaaatgataaagaatacaatgaaatgtccagagtaacacttggtctctacctttctaacattctaacccaaggccagtgtcatgggcttggctttcttccctgtcgcctcatactgagtatgcaatttacagaggacatctgttgctttatgtcttaaggccactagaggaagtcactacattcccaacaaagatgtgtctttcggcttagtgaaaaacatttaacaagaaacaatgtgtaaccaagtccccacagtaaaatgtgtcttcagaaacatgagaatcacttttatatagccaacctcatttgaattttatcatgaacataaattatcggtgagactggtgtgcggggctggatctgtgagacaagctcacactctcatgtgtgcattctctattaacatatttggaagattgcccacattttctctgcagacctgccacaaatccttaccttcttactgaagaatgtgactattgtagcattcgtgcaattatgccagcagaggaggcactagacagtttatagactcttatggaagttgggcacatttcccaggcaggtggaatgctagctagatctagaagcacccttaaaggtcatgtagaatcaaggtcccactttatgtttcccttgggagaaaactgaaacccatggatgctgtaatttgtttaacggcaaagaaagagccaagaattgtttctcgtagttccagggtcctgatctaggaatgtttccttggctccatggcatctcccagtttgacatagtgggagctgagaaatgccatatggcctcaaaataaataaacccttgtacatttaagtgttttcccagattttcagatgcctctactcttgctgaactcatcaccagctgtatcagtagagaggtgttatggggcaattcattagatttctggtaggtcatgaatggttggtataagctttatttactcatatattgtcatccagttctttgaaattcaatcttatcctaaagtggtagtcaaagtaaaacacattaagtaggtgtttgtgtttagcagtcctactaattcatcacaatcacatagtaattgtgattataatttttggaatctttatcactttctagcactttacggtgtcattatttatggcatttttaacaactttgttgcataattgataacatcagggctacatttttttcatgtgagcctcaagaagcttccattatcaacaagaattggggaaatgacttttttacattataataccttatatattaggtttttcctgataatcttcagtagacaatgatttaaattaactgaagtttaaataagaaatatgttaaaattactaaataatatgaaaaccacattatacttgtaattttcagacacttttctcctaccttaagattttaacatcttgtaaatattaatatttgaaggggagaggaaaaatacatttgtagtagaaatattccctctaacaattctgtttaactagtaagttttttttaagttatcttccatgcctgcttccctagtctgaactccacattccagttgtcagaagaatgaatggatttaaattttctaatcattattttgggcccatgttagcagttgaaacaattaagttcctcactctttcctgcttttaggatgattttagactgtgagcataaaatcaaccctttctgtcagcacagaattgaacatcgaatggagcaaggtctacactctcagcctgtagctgtgctaatgttaggattgaattgttctattaattccctcaagagacccacagcctcaaaagagttgcttattatcagatgtccgaaattcagaaacccaaagtcaggcaaagaaggaaactgagataatgatttaatttttttaagtcactgcaggatttctctcaaagaaaacatctgaaaatggttgagaaagtagttccagatcattaactattttacagagggactgaaagccagggaaaataaagaacagaatgatagtagtatcttgatattaaatttgcatcagaaatgagcaaaatatgtcaatatgaaataatttgaaatcaaattcagattcacatgtatagtgcatagttcaagaaataatgcttactcttgtaaaaaaaaaaaatatatatatatgtatcagcaggtagagtgtgggagctccaactttgttgtgaaagctgataacagagtatgattctttccagttacaaaatactgtattactttagttatagcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacacacacacatttttggcttttgacccactctgtgtgttccactgaagttatcttttccttaatagattcacacagaattaccccatcctgcaaaatccttatccctatgaatctctaaaatatattaaataatgtgttatatatttgctttttgtaaatctttatttaattaatttatatatactttgtgaagtcttatactgtacatcataaagcgatgtcatctgtagttggttcaatataatgtttatgatcattttgataagaaataactttggacattaggcccttgttaagaaataaaacacccattataaatttgcttctgttggaaaatacatgatttggcatacttcatttttagtaacaatctattctagataaatgataatttggggacatctgtacttaaaaactagctgaactacgttttgggatgagatgcaaagcaacagctgtccctggaactgaaatgtgaatttctagcagaacagaaaatattataataatgaggcaataataaaattaggaaattaaattatttttaaatctgtctgtgtgatttttccccttggtaaaaatacatgaaatacataattgaaaaattaccttcttctgaagtcgtagtttttaatcttaaccatcaataaataaacctattgttaacaatgtcttattcataattctaaaaaatttacaaatgatattgctatgaggttgtgcactattaaagtttgctccatcacttaaaggtaaagcagttcaaaaatactactttacatcacaactttgcatggctgagattttgaacaactaaattgatggttttacccacaagttatttcataaagctaacactgtaatattacttggttttcttatacttttgttatcatgtgatgaaatgtaactatgtaattaaacaaaattctgacaatcatattctgctaatgtttaaaatgttacttattccttcacttattagcttgctattttgaaaataaagtgaaagaaggccctttattaaatgaaa

SEQ ID NO: 5956 - DNA, 502 bp, Homo sapiens
  ENST00000582172
ccatttgggagcctttagaaataaaactgctatagatattcatgtgcaggatttatgtggacatgttttcatttatccaagataaatgctcaaggggctaattgctgattcttaaggaccctggaagtcccacagcttgcaaattctaaactgctagttgaaagcacgtcacttccagtaggtgaccccttaagtccatgaagatgcaaacaaacagccaagagatctgaaagtaaatggatttcatcaggctaaacaagagctggaggccgaggagtggtgcaagcacctctgcatggagtgtctggggaccaggctcaatgatatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtg

SEQ ID NO: 5957 - DNA, 529 bp, Homo sapiens
  ENST00000584435
tttagaaataaaactgctatagatattcatgtgcaggatttatgtggacatgttttcatttatccaagataaatgctcaaggggctaattgctgattcttaagagctggaggccgaggagtggtgcaagcacctctgcatggagtgtctggggaccaggctcaatgatatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgc

SEQ ID NO: 5958 - DNA, 506 bp, Homo sapiens
  ENST00000582992
agctggaggccgaggagtggtgcaagcacctctgcatggagtgtctggggaccaggctcaatgatatcagccttggggagcccgaccttctggccgcaggagtgcagcgggaacagaatgagagattcaacgtgtatcttatgcctacaccaaacctggatatttatggtgaatgcacaatgcagatcactcatgaaaatatctatctctgggatatccacaatgccaaggtcaaactggtgatgtggcctctcagctcactgaggagatacggtcgggactcaacgtggttcacgtttgagtcaggaagaatgtgtgacacaggagaaggactattcacttttcaaacaagggaaggagaaatgatctatcagaaggttcattctgcgacactggccatagctgagcaacatgaaagattaatgctagaaatggaacagaaggcccgggtaaggccccttccttggtaacctatcagcttggaaatgaatgtcactgggatctga

SEQ ID NO: 5959 - DNA, 417 bp, Homo sapiens
  ENST00000577609
gactattcacttttcaaacaagggaaggagaaatgatctatcagaaggttcattctgcgacactggccatagctgagcaacatgaaagattaatgctagaaatggaacagaaggcccggcttcagacaagcttgactgaaccaatgacattatccaaatcaatatctcttcctcgcagcgcgtactggcatcacatcactcgtcagaacagcgttggtgaaatctacagtttgcaaggaaatcatgaaaatcggcactccgatttaacaggaaagagttgcaagaaatccgagaacagatttcttgaagaaaatgcacccttggttatgtatggcatcactcaccatctgttcatggatacttctacatgcaaagttgtacatgacttggaataaaccagctctagttttatcatca

SEQ ID NO: 5960 - DNA, 623 bp, Homo sapiens
  ENST00000270190
gacccgcgcggtggggaagagccgctgccgctggttctccggctcttcctcggcggttctggctcccggccgcgccgcagccctgcccagtctctctcccccagcccggagggctcctccgcgccgcacgtgagcgcgcccgccaacagggccactgccgcgatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcag

SEQ ID NO: 5961 - DNA, 7685 bp, Homo sapiens
  ENST00000399151
ttcatctcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcaaacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgtgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctcctgccacacggacagcgagaacacgtcctccttctcctccccttcccacgacctgcaggagctgagcaacgaagagaactgctgtgcacccatccccatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacctctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggtgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggagctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaatgccttgtaatatatttgaatctgattctgcatttcttcctcaatttatgtaatgaaaataaaattaatatatcatctaacagtagcacaaaatttgtaatatgaagtaaagtatgaagataatgaagaagttgttttctttgttgaagcagttatatgggtctttctcagtatatttctcttttctctaaaagtttaaacttattaaaagaatgttatttttaacctttca

SEQ ID NO: 5962 - DNA, 400 bp, Homo sapiens
  ENST00000492760
gcggatctcatatcttcacttggcaaactcaacaagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagacccta

SEQ ID NO: 5963 - DNA, 2178 bp, Homo sapiens
  ENST00000463668
ctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggtaatacagtcccccgtcctccaaaaacttccttaaatacagatgctattgcagtgagcatgcataataaatatctggttttatttctagactactagagagccattgttcagaaaatatcttaaagttgtcataatttcttcccaaggtattgatctatgcttttccttctccagagagttaacatcttaaaatctgtgcagcgtactttgaacactttatatgagcgaagctttatgtgaggcctgttaaactttaaaaggcttggatttgcattaaattgatacagaaaaagaaaaaaaccacatatagggaagtgttaaagacctcttttagaaaaaggagaaatgggccaggcgcggtggctcacacctgcaatcccagcactttgggaggtggaggcaggcggatcacttgaggccaggagtttgagaccagcctagtcaacatggtgaaaccctatctctactaaaaatacaaaaattagtccggcatggtggcgtgcgcctgtaatcccagctactcgggaggctgaggcaggagaattgcatgaacccaggaggcggaggttgcagcgagccaagacctcaccactgctctccagcctgggtgacagagcaaggctctgtctcaaaaaaaaaaaaaaaaaaaaggcaaaatgattgtttctggtggcgttctcagtgtgccttcccatgttttatgtggagaggtatctgctttgatttgctaagttaatatatgtattaggtgtctcagctaagagagcattaaaggggattccgcaggtttttccccatggatgaaaaagaagctttactggacctcattcagatcttacaatggctgcatcccaggtgcagctctgtgttgcagaaaatgagggtgaggtggctgggtgcggtggctcaacgcctgtaatcccagcactttgggaggctagagtgggtgagtcacttgaggccaggagtttgagaccagcctggccaacgtggtaaaaccctatgtctactaaaactacaaaaaattagccagggcttggtggcagcatgcctgtagtcccagctactcgggaagctgaggcaggtgaatcacttgaacccaggaggcagaggttgcagtgagctgagatcacaccactgcactccaggctgggggacagaatgagactctatctcaaaaa

SEQ ID NO: 5964 - DNA, 1138 bp, Homo sapiens
  ENST00000556509
atggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctggtcacccaacctgcctgcagtttaccctgaacatgaccgaggctgtcaagacctacaagtggcagtgcatagagtgcaaatcctgtatcctctgtgggacctcagagaatgatgaccagctactcttctgcgatgactgtgaccgaggctatcacatgtactgtttaaatcccccggtggctgagcccccagaaggaagctggagctgccacttatgctgggaactgctcaaagagaaagcctcagcctttggctgccaggcctagg

SEQ ID NO: 5965 - DNA, 3755 bp, Homo sapiens
  ENST00000557704
atatttctgaggtggccctttgggagcaaaaagaaacattacatttacaaaagtaaacattttggccccacatagaaaagggcccctaccagcatagtctcttgttagaaaactcttcttgggcaaaaagaatggaaaaagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgc

SEQ ID NO: 5966 - DNA, 3687 bp, Homo sapiens
  ENST00000366353
attctcgtcttcacccctggccactcctggagttgaaaaccaggttcgctcccggggacggtagggggttcctaacgcaaaggaatgcacagggagaatcggacgtgtttgcgccagctcgtcgcccatcagaaatagggaaaggggtaggaaggccccaggtttcaaatatatttatatgaaagctgccgttaagaggacgttggaagctgaggctgatcagataggagctcctggcttcagttctggctcggaagctcggatacactgcgcttgaacgccacagcgtttcacccaagaaagaaaatgttttatggcagaataaatgggcgtaacttcgccgcatcctcgctgccggttgctttcgctgcaacaccgctgatgctgtttctaccgaacccacaactgattttcagtttccccatttccagccgaaatcacataaccgggctgatgccacctggtaaactcaagttagagaacctatttcacatgtgcaccaggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagc

SEQ ID NO: 5967 - DNA, 3229 bp, Homo sapiens
  ENST00000381216
acattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagc

SEQ ID NO: 5968 - DNA, 1514 bp, Homo sapiens
  ENST00000546183
acattgtagcaaaatggcgactgtcattcacaaccccctgaaagcgccctttcaagaatcctatgaaagttgtggatcatctccccggaaaacacgcatatagatgtgaacatctgcctatggttttatggggttcacagacctggaagagcccatctctggatgccctggaggcccatgggctctagggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaata

SEQ ID NO: 5969 - DNA, 569 bp, Homo sapiens
  ENST00000556891
aggatgcttgggacgcagctctggtctcagcagaacccagacgagtggctgttgccgacggctggtttgtccctgccagtcattctttctgtgagtggcagcccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacct

SEQ ID NO: 5970 - DNA, 482 bp, Homo sapiens
  ENST00000556997
tgaagatggaaatcaatgacttagaaaccaattaaacaatccaaatagcaactgataaatggattaaccctctataatgaaattcctctagcttttgtcttccgccttccccaggtaggttttctattcctggaggcaaagcagaggcatggaggaagtggaggccagagggaatcacattaaagtgggtgaatccgtttatcacttactgtctggatggtatttctgctcacatctctgcttcctttttcagatttgtaccgtatgggaccctgattaacgttagccagtgaataatgaaaggcagcagcagacactgggtctgcccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaagga

SEQ ID NO: 5971 - DNA, 513 bp, Homo sapiens
  ENST00000556238
gcatttcgtttctcaccttttctatttttttttttcatttcagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaagga

SEQ ID NO: 5972 - DNA, 562 bp, Homo sapiens
  ENST00000554594
caggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggcaaaggaccggatggaacagtcattcccaataactactgtgacttctgcttggggggctccaacatgaacaagaagagtgggcggcctgaagagctggtgtcctgcgcagactgtggacgctctggtgagtgtggccccttcccacaccgggtgcccgtagaccaggaatgctcctcttgcattcctcttccatcttgtggtgctggagactggagagggaagcgatggtggcaatgctttcgagtggagaggagttttcagctcattctgatatttttcttctttgggtctcaagaaccaaaagttatgccctaggatccgggggaaagggcaaagagaagt

SEQ ID NO: 5973 - DNA, 347 bp, Homo sapiens
  ENST00000555781
aggaagctcccaaattcttttctgacttaacctatcttccgaaggagtcattattgccttcacctcggttcccttccctctcttctgtctgtctatgcaaagtgaatttgttgagcctagtgaacacagggactgtgcagggtcccagggacacagagtggacaaaacagtctgaatccttgtccccatggaaccaagagtccattgtctaggcttgaaacgtgggagcgtctgctccagctacggccacagggttttggaaaatgatgaaaatgtagaagaagggaatgaagaagaggatttggaagaggatattcccaagcgaaagaacaggactagaggacggg

SEQ ID NO: 5974 - DNA, 495 bp, Homo sapiens
  ENST00000553608
aggcttctccaccatttgctctctgatgttcggtgcgatttctcttctcctcaagacagtgcccctggctcctgcgacaccctcccaatccgggaacaacttaaggaacgccgaggtgccaagcatgtaacctgagattgatgagcctgtcagcggctccttctgcccccagccttccccctctgccgtgtgctcttcagatggatgagccaggcgggggtgggcaagaacggggagatggaggaagggacccgcggagcctcgagccagaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacggg

SEQ ID NO: 5975 - DNA, 550 bp, Homo sapiens
  ENST00000556902
ttcattgcgctccttctcccttcagggcaggcaggagcagggaggcatggaggagggtgcgcttatccagtggctggagtaggccaggggtttgccccctgctctgacagtttctctggagtgctggtgtgccacctggaagcattcacattcggtcactttattatccagggttgccctgggagtttggcaggagagagggagcaaaatgggagagtgagggaagcatatcactggagagggaagtagagatgtgatatgatctgcagaacaccgtgctctgtcctcagtgccccctccccagaggctccaaccccttctgagaacacaatgatcagcctcctgttcctcactggcttcttctttggacctggatttccacagcagacctggaggccatgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggca

SEQ ID NO: 5976 - DNA, 546 bp, Homo sapiens
  ENST00000555469
ttcattgcgctccttctcccttcagggcaggcaggagcagggaggcatggaggagggtgcgcttatccagtggctggagtaggccaggggtttgccccctgctctgacagtttctctggagtgctggtgtgccacctggaagcattcacattcggtcactttattatccagggttgccctgggagtttggcaggagagagggagcaaaatgggagagtgagggaagcatatcactggagagggaagtagagatgtgatatgatctgcagaacaccgtgctctgtcctcagtgccccctccccagaggctccaaccccttctgagaacacaatgatcagcctcctgttcctcactggcttcttctttggacctggatttccacagcagacctggaggccatcaccgagtaatatggagtctacaaagagatcagtccgttggaagccctccaggagcccaccacttagaagagaccgacaaaatgaactctgctgtaaggaaggtgaagggaaaggaggccaaggagtttcaaggctgaaggtgcct

SEQ ID NO: 5977 - DNA, 4077 bp, Homo sapiens
  ENST00000541685
agacaatattctgttacattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 5978 - DNA, 4520 bp, Homo sapiens
  ENST00000610283
attctcgtcttcacccctggccactcctggagttgaaaaccaggttcgctcccggggacggtagggggttcctaacgcaaaggaatgcacagggagaatcggacgtgtttgcgccagctcgtcgcccatcagaaatagggaaaggggtaggaaggccccaggtttcaaatatatttatatgaaagctgccgttaagaggacgttggaagctgaggctgatcagataggagctcctggcttcagttctggctcggaagctcggatacactgcgcttgaacgccacagcgtttcacccaagaaagaaaatgttttatggcagaataaatgggcgtaacttcgccgcatcctcgctgccggttgctttcgctgcaacaccgctgatgctgtttctaccgaacccacaactgattttcagtttccccatttccagccgaaatcacataaccgggctgatgccacctggtaaactcaagttagagaacctatttcacatgtgcaccaggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 5979 - DNA, 4221 bp, Homo sapiens
  ENST00000614862
agacaatattctgttacattgtagcaaaatggcgactgtcattcacaaccccctgaaagcgccctttcaagaatcctatgaaagttgtggatcatctccccggaaaacacgcatatagatgtgaacatctgcctatggttttatggggttcacagacctggaagagcccatctctggatgccctggaggcccatgggctctagggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 5980 - DNA, 883 bp, Homo sapiens
  ENST00000436732
aaatattttgcactggaaaaactataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaagaattctgaaaactaactaagatgctggagaaattgggagaccatttgttgaagaaatacctactgaatcttggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaa

SEQ ID NO: 5981 - DNA, 6278 bp, Homo sapiens
  ENST00000410059
aaatattttgcactggaaaaactataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaaagaaaaaaatcaatatattgaattctttaattaaataggtaagcagtattaaatcatccacagagataaacaatctcttgaaactcttttgaaagagaaaagtgtttgttcactttcattgccttcattaagatctccaaatactcagagactaagcaggctattctcatctctttgagtttcctgacagaactaaaggaaggaatcactcttcaaaagatggatctcacttcactctgaaaatgtgcctttttttaattgggtgtttagcataaaaatcactattggggatcttacagatgtctgttgtagatctattacaatgaggtgacttagacattgggctttaccatattagagaattacttaagccattgtccttcaaatgttgggcttggagacagaagtaccttggactgaattgctttcaagtctctagaatcactgacagcacatagcttctatgaggagttatatatgaaataccacttgtgtccctcctcaagttctctgaccaccttcacatcctgcggccaccaacactgtatggatacaatctggcctctcagctctgctcactttcactttctgttctggggattctctgatactaattttggctacttggtagaaccaagagacaaatcgcttacatgctgcaaaccgatgtgaaggtgttactaacccgctaaaacacaattaatgaaagactgtagcaggtaactgatctttccctcagatattctacatggtccatggaagactctgtgggccgcagaagcccatagctgcatacccttctattttcctcttccccatttcactcttttaagctccctactcctattccctatgatcactttccaaaataaacggcaggtgtgctagctgttgtcttagactctgctttctggaaactatttttcccctccacaagaaattatcactgtgaatattacaggaggagaaataaaataagaataaatcagtggtttattttca

SEQ ID NO: 5982 - DNA, 2165 bp, Homo sapiens
  ENST00000461250
atattgcattaaacacttgatgaaagaagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtatacatacatgaagagtggcttcaggactggatccattgctgtttacatgggcccattaaatggagttatgactattttctagtttatgaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagc

SEQ ID NO: 5983 - DNA, 3883 bp, Homo sapiens
  ENST00000409163
aagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtatacatacatgaagagtggcttcaggactggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaa

SEQ ID NO: 5984 - DNA, 457 bp, Homo sapiens
  ENST00000492708
acacatatttcggttggacataggtgggcactgacgtagattctttgcttcctgtacttatatgtgaatagcaaagtgttgagaactggaagcatgagtgagtgacatgcaaggaactgacattgaagtaagattctgtgagggtgaggttgcatttgtagaaagtggttatagtccacttagcaatggtcatcacagaggtggctgagggaccagtagatggttctgaaaagggattcctcaaaatttgcaattggttgatggcactcttcatctttctgatgttcatttagaagtgataattactgggaacctgatgctcagtactgtattaggcattaaaaggatgaagatgactaagggaacaaaataacagcttagaataattctctcctttttagagtttttccctaactttgtcaaagtataattaaaaaataaaaatgtctatattttc

SEQ ID NO: 5985 - DNA, 862 bp, Homo sapiens
  ENST00000393146
gagtgacatgcaaggaactgacattgaagtaagattctgtgagggtgaggttgcatttgtagaaagtggttatagtccacttagcaatggtcatcacagaggtggctgagggaccagtagatggttctgaaaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccac

SEQ ID NO: 5986 - DNA, 2758 bp, Homo sapiens
  ENST00000393147
aagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataa

SEQ ID NO: 5987 - DNA, 3052 bp, Homo sapiens
  ENST00000310323
ggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggac

SEQ ID NO: 5988 - DNA, 913 bp, Homo sapiens
  ENST00000486885
agttccaggctctcctgcttctccacggactctgcgggaagttagagcctctgcgtgcgctccggggcccggcgagaggatgcgcaaggtggagagccgcggggaagggggcagagaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaa

SEQ ID NO: 5989 - DNA, 553 bp, Homo sapiens
  ENST00000429914
atgcgcaaggtggagagccgcggggaagggggcagagagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacaatttttcattattcgtatactgcttcatatgtgatttacaacatacacactagggaagtttgggagttaaatcctccagaagtagaggactccgt

SEQ ID NO: 5990 - DNA, 565 bp, Homo sapiens
  ENST00000419287
gtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacag

SEQ ID NO: 5991 - DNA, 546 bp, Homo sapiens
  ENST00000488208
attgttggtgctagtaccttatcagttcattgggctcctttgaaatgctgaggatctgcttacacaggtcaactcctggcagaagcgggttggatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgccc

SEQ ID NO: 5992 - DNA, 548 bp, Homo sapiens
  ENST00000473362
tcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagt

SEQ ID NO: 5993 - DNA, 5075 bp, Homo sapiens
  ENST00000638088
gggacgagcccgccctccaccctccgcccgcccgcccgctggagagtgagctgcgcccagccgcccagccagcccgccgttctctggccgccgtccgggcgcgcgcagcgagcgggcgcgactatgccaagatggtcctgcaggcgcggaacaagcaccgggaggcggctcccaagccgccccagccaccccgcgcctcacagtcgccgctgaggggggcgtcggacgtcggcgccggggagccggggcccgagcgcgcgcccctgtccccggggcgcaagggcgccgcgggcaggaaggggccccgcgccgagcccggcgcgccgcccgccgggggcggccttggggggcgcctggccgcccggctgcgctgggcgctgggcctgcggcgcgcggggcgcggccggacctggaccacgctcctgttagctgtttttgcagcagtgttgcactggagccatataacacacctctttgaaaatgaccgtcatttttctcacctctcaacattggaaagggagatggcttttcgcactgaaatgggactatattattcctatttcaagactattgtggaagcaccctcatttttgaatggagtatggatgattatgaatgataaactgactgaatacccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgatttctcttgcactttgttttgttttgatgtttgggaactcaatgttattaacttcttattatgcttcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgagggaa

SEQ ID NO: 5994 - DNA, 4870 bp, Homo sapiens
  ENST00000310974
ccctaagtggccgctccgggcgccttctccctgccccgccgcgtctcgcctgcgcgggctccaagcgcagccttaacaggctccgaaacttgaatcagcgccccgatcccgagagggctcttccttcggccccatcactcccacaatggaagggcggccgcctccggaaggccgtccgcccccgcgtcctcgcaccggccgagccccgcgcgggcgccgaagagctgtttttgcagcagtgttgcactggagccatataacacacctctttgaaaatgaccgtcatttttctcacctctcaacattggaaagggagatggcttttcgcactgaaatgggactatattattcctatttcaagactattgtggaagcaccctcatttttgaatggagtatggatgattatgaatgataaactgactgaatacccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgatttctcttgcactttgttttgttttgatgtttgggaactcaatgttattaacttcttattatgcttcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtacatcctggtgctattgtgtttgctatattagcagcaatgtcaatacaaggttcagcaaatctgcaaacccagtggaatattgtaggggagttcagcaatttgccccaagaagaacttatagaatggatcaaatatagtactaaaccagatgcagtgtttgcgggtgccatgcccacgatggcaagtgttaagctctctgcacttcggcccattgtgaatcatccacattatgaagacgcaggcttgagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctttatcaattggttactatttcaatgcaccctttaaaatttgctatgcaaatgagtatatgcttgtacttgactttaatatttgtgctaaagtgagcaaagctacctgtataaagaaaacacagtgggttgtgacaaggatgacatgaaaatacaggacaattctgacaatgtaggggctgattttatagtgtaagaactattaatgccccttgcttcttttttctgcctcttgctcttgtcttttggacatttcagtgattgtaagttcttcggtcatgtcagcccctgtcatcaacttgagttacagtagatggggcagacatggagtgtttgctatatagaactatctgtttgttttacttccttgtgcgctttttgttctctgttctcttgttaatgaagcttttcctgcccattattaatccaaactcttggaccttgtggttaggaaattcccttaacttccagccatatggcattatcgtgtctctttctctctctctcttgctctctctcttctcctcttccccatattttctgtcaaataagtactgtttactcatttagttgcttatcaagtacttattcttggttttaaaaaaaattaatggtaactgtatttttctcatttttagcattattcaaatgtttatattttaatacctttaaaccactttaaagttttttcatgtttaattatagttttaagaaaaactattttgaacaaccccaaatatagtgcatctagaaactaatgtatatttgattagacatcatttatagtggaacagtagactgtagtacatggtaatttttcttttactattaagatacaataaaacatgactaattttgctgtcaaaaatgtaaagaataatgataaatggagtttttatattttacttttaagattgcctgtctttaataagacaaagccttaagccttatgttataattttggttctaaaaaccatcatttcagtataaggaataagtatatttcgtcctcctctttagtttttttcttcctatttatttttattttgaaaaatttctacaccttctttgaattccttgtatgaatttttgtttcttagaagttaatttgtgtgaaatgagattcttcaaaacgatgaaacctcatagctctgagaaaaggttttagggttttaaattctaagcaaagcgtgactatggctgacagactacacatttaattatacagcttctctttcttaaccacaggcagattaacctcattgtggattgtccttcagaccttagtcctcaggcatggtttctggtgcccactcctggaagccgctgttccctttctaccttcttaccagagcccaagggcaggcctggtcccggggaagcagcagcttgctgacataagtcagctgcaaaggctgaggagtgtgccctcagagaagcaccgccccccagtcttgtgccagcgcctagagccgcagctcccagggatgctccttccctggaggcagcccaggagagggactctggcagcgttcttcagatttgtggccactgtttctcatttgctggttgactgtttttatttcttaggcttttgctagttttagaaaatagggaagcagcccttgatttgtggattaaaagcaacatttgagcgatgatgcacaacagtccaggaaaatgggcggtggacacttgaggctgaggatgggagttgacatgagcagggagagggaggtgcgcgctgcttatctgtgattgttgctcacctgagtgtggctgattgtgtacatccagcagttacaatttttaaaaattatacttttacatttattttatatttttctcacccccagtaatttccttccaaagaagttcacatgtaataagtagaaattctgtataggaaaaaagcattaaaaatactattataactgcttcatttgctgggaaccattaaaagtaatataaattagctttttccagaaggatccttttgtagcagtgtttatgaatgtaacccccagcaaaatatggctatatattaggggagccagtttggagcagaggcctgaaggtccctgctatgcagccgtggccacagctcgcagcccaagcactgtggagcatccacacctttgatggcaatgcagattggtagcaggttccataggcgtacaaaacagtattaaagctcagtgttttgcatattgttagcatttacaaatatttttgctttagtatgaggaaagtaaggatgggcaaagaagcgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtactatatatgttaaattaaaaaaaatcatgagtaatgagggaa

SEQ ID NO: 5995 - DNA, 255 bp, Homo sapiens
  ENST00000428054
gtttgcgggtgccatgcccacgatggcaagtgttaagctctctgcacttcggcccattgtgaatcatccacattatgaagacgcaggcttgaggcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgct

SEQ ID NO: 5996 - DNA, 619 bp, Homo sapiens
  ENST00000446375
tgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcaaaattctttagttataaggattttgatactttattgtatacctgtgcagcggagtttgactttatggaaaaagagactccactgagatacacaaagacattattgcttccagttgttcttgtagtgtttgttgctattgttagaaagattattagtgatatgtggggtgtcttagctaaac

SEQ ID NO: 5997 - DNA, 293 bp, Homo sapiens
  ENST00000493989
ggtattctggcaatgaaaccacatttcctgaaaataaatgtatctgaacttagtttatgggttattcaaggatgtttttggttatttggaactgtcatacttaaatacttgacatctaaaatttttggtattgcagatgacgtaagtgcattttttacttaaatttgaaagacttgaaaagaatcgaataggctaagaataaattgagttattcaagtatcactattaaatgaaattctaggatgaagtctgttcacctattattttatttaatataatagaaagtaaatgta

SEQ ID NO: 5998 - DNA, 574 bp, Homo sapiens
  ENST00000462134
aggaagaccactgtttgtaaagtgcaaaggtctatcgtgctaccctcagtgtatactatggtttttaattcttcgtcttacgttttcttataattttgatactcatgtggcatgaacatcattccttacaaagttttcttaaattttaacaatggaattcagactattcaactggcttttcaggctgatgaattgtctttttgatacttttcagctacttggtgtagctgaaaagcatgcttagacatcacttttttaggaaaagtgtacccgtgtaatgtggacaccacctctccgtgaaagcttctcatatccatttcttgttcttcagatgttgctagtgactcatattctcagggctacaaaactttatagaggaagcttgattgcactctgcatttccaatgtatttttcatgcttccttggcagtttgctcagtttgtacttcttactcagattgcatcattatttgcagtatatgttgtcgggtacattgatatatgtaaattacggaagatcatttatatacacatgggtattctggcaatgaaaccacatttcctgaaaataaat

SEQ ID NO: 5999 - DNA, 461 bp, Homo sapiens
  ENST00000463538
gaaggattctgaggtcccaggattttgctgttcttcagctgatatttctgtatgcattgttttggtttgataggtggaagtttactctttctaatattgccatttttcaggatcctattgtgctccatttttagctgtcatacatgtaattttataattattctaatagtttcctcagttaattttacttagactcatttattgaactaacgacacattggagggaaaggtaacatactgcatgttggggggcggattcttaaatgtctgcttttgtgattacacatttccccgactcctcattctccagtggcagccgattaggaggcctggttacagtgttgtgcttctttttcaatcatggagagtgtacccgtgtaatgtggacaccacctctccgtgaaagcttctcatatccatttcttgttcttcagatgttgctagtgactcatattctcagg

SEQ ID NO: 6000 - DNA, 566 bp, Homo sapiens
  ENST00000481923
acttgtgcctcgtcccttatcagctccccatgagattccaggctgctattttaatactctgttactatcttaaatcgggtcgcacccgttcttcttgtcgctgtttttgcagcagtgttgcactggagccatataacacacctctttgaaaatgaccgtcatttttctcacctctcaacattggaaagggagatggcttttcgcactgaaatgggactatattattcctatttcaagactattgtggaagcaccctcatttttgaatggagtatggatgattatgaatgataaactgactgaatacccccttgtcattaatacattaaaaagattcaatctttaccctgaggtaattttggccagttggtaccggatttataccaaaataatggacttgattggtattcaaaccaagatatgttggacggttaccagaggagaaggactcagtcctattgaaagctgtgaaggattgggagatcctgcttgcttttatgttgctgtaatttttattttaaatggactaatgatggcattattcttcatatatggcacatatttaag

SEQ ID NO: 6001 - DNA, 607 bp, Homo sapiens
  ENST00000612226
atgcaaacagacagtgagtggaggacaccagcaaagtaataaggaatgtttcaaaaggatatgatgaactgaggcttatcgagtcagggagcagaaagctgaaataagaccgctaagctctaaacaaatccgttaaagcttcacagggcagagccagaacaaaaatagtatactcaatgtatagtcggaaagcagccgaagaagtgaagcgagaactgataaagttaaaagtgaactattacattctagaagagtcatggtgtgtaagaagatccaagcctggttgcagtatgcctgaaatttgggatgtagaagatcctgccaatgctgggaaaactcccttatgtaacctcttggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaatagaaaacgttttatttggtcaatttgaatgtcattctaattataaaaatgacttacacctt

SEQ ID NO: 6002 - DNA, 4060 bp, Homo sapiens
  ENST00000324472
gcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacagcctctttacctctgtgaggaaattgtaacagtgtgtcttttaaggtgtttttattttaccagcccttaagaaagatctctaataccttttaatacttttttttaataatttcaagttgaagtgtttttaaaaacactttgttttgtaatgttttgaatctcttgagatgtgtttaccccactagatacatatttgccactggttagttctccatctaagctcaagaggttattcatctctctttagattccagtggcttttcttttaacatccaggtaaaacagaaactgctatggtatacaaccaagttttggggttaaacataatcagaaaagaaaatccagttaaatttatgaagtgagattttcagatcctagatcttgaataaaggaaaggtcttttcatcttgatggccccaaagcttgttggtcatggtctttatttctggccactatcttcttaaataatatatttttaagccctcatttatttttggttttgggtgaggaaagtcatgttttctaagtcctctcccctaataaaacctacccaacaatagtgctttgaaaagtggtagttatcttgaagatactcttgccaaatgcaaagataaacattctttttgtctgctttataaatatgaaatatgccagatctatagtattttaatgtgcatctactttaaatgagtcatcttggggtttttataattcccttatgttcttgcccctctacacttgaaataacaaaatgccttaattttatggattagttctcttatagtagacaggcagctatatgcagcaaaaccaataaagttatttttcaactttcatagttgtaaaatatcttataacagaatacaaaacagctaagaaaacatgccacattttattttagcattttcaaataatttgtttttggtgtaagcacaggataaaaaaggagagcgtcaaagaaaagagacataacacctaacattcataaaaattaacaaagtatattttggatgatgtttttacaggaaatattttaaataagttggtagaacttttaaaatggtactgtattagctaataaaatattcagtacaaatatatgtttggatttatgcattaaaaaactaataaaattatttccaacttt

SEQ ID NO: 6003 - DNA, 850 bp, Homo sapiens
  ENST00000541911
tcatgtatatcggtgttccatccagtgagtattgagatttcaatttgctagtaagatttttttagtctattctattatcatttattttaaaatcttttaaattattgtttaaatttaaagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtcctttttcatccaactaggtgaattgcttcagattttctctagtaccagagggtacctcctcaaactctttgaaccacttaaggcagaagaatgcaagctctgaaatgacatccttaaaatgctgatactggtcacag

SEQ ID NO: 6004 - DNA, 1339 bp, Homo sapiens
  ENST00000413230
tacactgtatatataggttgaatagaaggtcatcctattcatttattaatgagaggtacaatctctagggatctgtaaaatctattttgtcttaaccaaagaacaaatttttgacatatcttgaataggatgactataaattatgacttttaaattgttgtaatttttgtactattatctgatatttttatttttatgtattttcgtaagtagtttagagatagtcacattttaaaaatctaagatcaagcaaatgaagcttatttttatgtattcatagtataaaagaccttcagtaaataggtaatatttttgttttattctagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtcatactgcataaacaaatgttcatttcagaattttaaagagaaatgtatataaaagaacaatgaattttaataaatcaggggtatgtaagtc

SEQ ID NO: 6005 - DNA, 1173 bp, Homo sapiens
  ENST00000439061
caataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagacagatggagcacagggaaatgtgtcttggcattctaaaaaagaatgaatggagaaccctggacactgttcccataaggagtacatgaagggacttgggatatttaattggataatagaagattgaaggaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattac

SEQ ID NO: 6006 - DNA, 1549 bp, Homo sapiens
  ENST00000306389
tttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaag

SEQ ID NO: 6007 - DNA, 603 bp, Homo sapiens
  ENST00000541083
aactacataactagtaacaagaaactgaactggggaagcagagagtaaatggagaattttgatgacatttcatgatactaagattttccatcagagctccttcctacataacaaatgctgatgataataataatattctatattggaagtgagaaattctgccaagaagtctcatgctgccaatagcctacaaagaatgaaattataaccccagctcaattggtgctgcatgtttaaagtattccgtctgtttaacttcataaaagttggcccctttcagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatct

SEQ ID NO: 6008 - DNA, 882 bp, Homo sapiens
  ENST00000536494
gcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcccgtccggggctgtacatggggctgcgcgcaagctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtgagtcataatttgagacaaataatatttgtagagtgatcctctttgtcagataaaaatagtaagcacaatcttgttaagaaagggaggggacgtttcaggtttattaattgtgtgtatccttatagttgagtagaatatcataagttcctctcttaaaatttaaagaccccagaaactgttctctcatgaactcgaagaatgaaccttagtgtgtaaataatggccagggtaatagacaagccaaatggaaaagagagtcatgggagccaaaaagttctaaatagggatgggcttttggctttggacacctcgtgggtgagcatgatgaccacgtgaagggacagtaagagtgatgagcttgaatagtgatcttggagttaagttagtaaagtaagatttatttagtcacacagccagaaatctattactattttccaacacttagc

SEQ ID NO: 6009 - DNA, 491 bp, Homo sapiens
  ENST00000538147
gtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggaaggaattgaaaacaagcagttccccaaccaaacgggcacaggctgcgtttgcagctcctgtaaaagctccatacccagagcagtgtctcctagctcccagctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgct

SEQ ID NO: 6010 - DNA, 505 bp, Homo sapiens
  ENST00000542209
cccaatgaagcgcgtgaagggcaagcggtgatgggttctgcgccagtggggctgggagcccgtccggggctgtacatggggctgcgcgcaagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgca

SEQ ID NO: 6011 - DNA, 680 bp, Homo sapiens
  ENST00000522422
ggcggcggccaggagctacagctgtgggctgcactcccggcgtggagtctccttcctgcccgcgcaggccccggcgccccagcgaaacgctccggccgctcccctctcccaacactctggttcccgggccgcctgcggggacgcggttggcggcgacaccggaggggggtgggtcaggaagtgggggcgcggcggccaggagcgggcccccggaggccgaggggttcggcgacgcggagggagggagagtctgggccgcgcgggagccgcagggcgccctagccttcgcagaaacgatggcggaggaagaaggaccacctgtagagctgcgccaaagaaaaaagccaaagtcttcagaaaataaggaatctgccaaagaagagaaaatcagtgacattccaattcctgaaagagctccaaaacgtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttc

SEQ ID NO: 6012 - DNA, 581 bp, Homo sapiens
  ENST00000520774
gtcaggaagtgggggcgcggcggccaggagcgggcccccggaggccgaggggttcggcgacgcggagggagggagagtctgggccgcgcgggagccgcagggcgccctagccttcgcagaaacgatggcggaggaagaaggaccacctgtagagctgcgccaaagaaaaaagccaaagtcttcagaaaataaggaatctgccaaagaagagaaaatcagtgacattccaattcctgaaagagctccaaaacgagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatg

SEQ ID NO: 6013 - DNA, 6197 bp, Homo sapiens
  ENST00000414645
aggagcgggcccccggaggccgaggggttcggcgacgcggagggagggagagtctgggccgcgcgggagccgcagggcgccctagccttcgcagaaacgatggcggaggaagaaggaccacctgtagagctgcgccaaagaaaaaagccaaagtcttcagaaaataaggaatctgccaaagaagagaaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaaggtttatgaagtttataaaatctacatattttccctctttctgggatatttactacagtttgagaatccagctttgttggtatctcctttattaagtttagtagcagccttaatgcttgctaagtgccttcagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattgggttctcttgcaatggttatagaaggcttgaagtacatctggattccttatgtgtgcatgttagcagcatttggtgtatgttctcccgaactttggatgacacttttcaagtggcttcgattaagaactgtacacccaatattgttggctcttattctgagcatggccgtgcctactataataggtctcagcttatggaaagagttttttcccagattaatgacagaattaatggaactacaggaattctatgacccagatacagtggaacttatgacctggataaaaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctactcaaaatatgggcgattttgtcatgaggtcaaaattaactattctccatatgtgaattatttcactagagtatactggaacagatcctactttgtatataaaatcaacactgtgatatccttccagtcttgaaaaataacagagccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttcaagcaagtttctgaaggtattttatgatgtataacaactgaagttttacaataaaaactaatttaaatgttagctgaagatatgtggcatttaaattaaaatggaaattatataaaggaaagtgatttttaaggatatacataaagatatatttagaattttcatgatactgttctcctcatctactgcttatgttaagtgagaactttcttagtaatacataatgcatgatgttactgcattttctaaatgactagtaagtgattagttttttcacttatgcctattaatttgataccaatttaatcatgataaaacaataaccgttaacatatattttgttaaatggacatttaaaagaatgttgttcaggttttttttttaaatactgatatggggcatacaatctattcacatgttttctactgaagtactaagtaaaaaaattaaatcattatcagaataaaaatatgtgttctaaaattagcaacaatttctggggatacatgcagatgttgttaaacgtacctctgcatacagatatattataaaacacaagcaatgttatttatgaaactgtgatgcagtcttcaacatcaagaaaaaatgacaactataataaaatttacaacacagtttcacagtctaaatgctatgttcctttaagtattttcatatttttaatcatttattaagagaaaattgtgaaaagttaatttggccttatagagagattcaggatagatgtagcctatagatgtgtcattttaataagttgggatacatgtttagtttttccttatattcctgttcagtgaacagattttcataattctcacttgttaaagtgctgcaaaaattgcattttcagtactctaaattactacattagaagagagcatttctccattgtctttattttctgttatatatgtgttgtaaaagtacactacattagaagggagcttttccgttgtctttattttctgttatacatgtgttgttaaagtacatgcattcttagactaactctcagatgctttgctcttttggagctgaagaattgtttgatggtgatgtcatatatctgatagattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttgtgattagagcatgtaaaacaatgtaattgaaaagtcagcttccatattttgtaggggaaatagaacaccctactttttatctagtgtgaaatatttaatcgaatttttgttgatttatattatgttacctgtgctgaattaggtttggtacttgtgttttgtttgacatattagtaagttgcttttgcttctttctgtcaacttattttttaaataaaattgatctggaaaaattgttaatgggatgttttaaataatgaatttttcatccagcatcagttgaaaaggaaaagaaagcttcattatggaaatgacaatattgaatatgacagataagtttatttgcttctgttttaactgcagttaatagtactagacaactttaagtggaaagcatttagtttatttcttcacttatttgtagagtgaacaaatgattcacaattctacaagtaattccacttaggtaacttacagttgttaggtttgacaataaagatctactatgagaggagaagaatttatgggttttgggtggaaggaatttctcaaagaaataaaaaatgttctttgcccttgatactgcaaacccactgatacaagtgccttgaatttattattattattattttttatttttttgagatggagtttcactcttgtctcccaggctggagtgcaatggcgcgatcttggctcactgcaacctccgctcgctgcaacctccgcctcccaggttcaagtgattctcctgcctcagcctccggagtagctgggattacaggcacctgccaccaagcacggctaatttttgtatttttagtagaaacggggtttcgccatgttggccaggctggtctcgaactcctgacctcagatgatccactcaccccagcctcccaaagtgctgggattacagacgtgagccactgcgcccggcgcaagtctttgttaaaagtagagatggaggccaggcgcagtggctcactcctgtaatcccagcactttgggaggctgaggcaggcagatcacgaggtcaggagatcgagaccatcttggctaacacggtgaaaccccgtctctactgaaaatacaaaaaattagccgggcagggtggcgggcgcctgtagtcccagctactccgaggctgaagcaggagaatggcgtcaagcggcgaggcggagcttgcggtgagccgagatcatgccgctgcactccagcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatttactttctgtgtatataggcagcatattttttttgtagaacattaacccagattgctaatagcttcatgttacggcattcttccacacagtccagattgatttaaggaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaaccaaa

SEQ ID NO: 6014 - DNA, 340 bp, Homo sapiens
  ENST00000519353
gaagagaaaatcagtgacattccaattcctgaaagagctccaaaacgagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttaca

SEQ ID NO: 6015 - DNA, 1124 bp, Homo sapiens
  ENST00000519176
aaaatcagtgacattccaattcctgaaagagctccaaaacatgtattatttcaacgctttgcaaagattttcattggctgtcttgcagcggttactagtggtatgatgtatgctctctacttatcagcataccatgaacggaaattctggttttccaacaggcaggagcttgaacgggaaatcacgtttcagggtgacagtgccatttattactcctattataaagatatgttaaaggcaccttcatttgaaagaggtgtttacgaactgacacacaataacaaaactgtatctctgaagactataaatgcagtgcagcaaatgtctctgtatccggaacttattgctagcattttatatcaagccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagttgcacagacccctggtacagtgtgggaggtgacaacacaggatattaataccaggaggcaggaatcattgggaccgtcttggaggctggctaccacattcaattaactttgctattaatttcatgtaatccctatatctgtcttcatatttgaagaggaaaagatactttctcatgtaaacataatggttttaaagaataagactctcttatgctacttaaacaaaagaataagactctctttagagatcttagtgagaattgtaagaaataaaataaacagaagtctgactgccttatttgatgtcactgatgtatgttgtattgctggagtagaagttaaatagaaaaattgacctggtatattctactcaaatgtatcttttgacaattgaaatgttcttaatagctaagttttaaaaaatgcgtttgtttgctttttgtttatattttattggtatgtatcttgtactgcaaaatacattttaatgccatgaaagaatatgctgtctctttattcatcagctttatagcttttatttatatatgacttcttagaaaagtataaaaagatattaaagtcattccattatattatga

SEQ ID NO: 6016 - DNA, 802 bp, Homo sapiens
  ENST00000521525
gccactggtagcaatgagattattgagccagtgtatttctatattggcattgtttttggattgcaaggaatatatgttactgctttatttgttacaagttggcttatgagtggaacatggctagcaggaatgcttactgttgcgtggttcgttattaacagggcagcatgcaacttggcagctggtctcccttacagtgaatgatccaagagagtatgagagagtgtgccacaatggaagccaggtatctgttataacctcatcttagaaatgatataacatcactctgccatattttgtcagttgcacagacccctggtacagtgtgggaggtgacaacacaggatattaataccaggaggcaggaatcattgggaccgtcttggaggctggctaccacattcaattaactttgctattaatttcatgtaatccctatatctgtcttcatatttgaagaggaaaagatactttctcatgtaaacataatggttttaaagaataagactctcttatgctacttaaacaaaagaataagactctctttagagatcttagtgagaattgtaagaaataaaataaacagaagtctgactgccttatttgatgtcactgatgtatgttgtattgctggagtagaagttaaatagaaaaattgacctggtatattctactcaaatgtatcttttgacaattgaaatgttcttaatagctaagttttaaaaaatgcgtttgtttgctttttgtttatattttattggtatgtatcttgtactgcaaaatacattttaatgccatgaaa

SEQ ID NO: 6017 - DNA, 828 bp, Homo sapiens
  ENST00000523020
tattgagccagtgtatttctatattggcattgtttttggattgcaaggaatatatgttactgctttatttgttacaagttggcttatgagtggaacatggctagcaggaatgcttactgttgcgtggttcgttattaacagggtagatacaacaagaattgaatactccattcctttaagagaaaactgggcactaccatattttgcatgccaaattgctgcacttacaggctatttaaaaagcaacttaaatacttatggagagaggttttgctacttgttgatgagtgcttcaacttacacatttatgatgatgtgggagtatagccactatctcctgtttcttcaagcaatatctctattcctgctagataccttttcagtggagcaaagtgacaagctgaatgtgaagaaaggaagttttgtagctaaaataataaaagtgattaatttttacttggtgtgtactctgacaataacattgaatattataatgaagatgtttgtcccacacaaagaaaatgggcacatgctgaaattccttgaagtaaaatttggactaaatatgaccaagaattttacaatgaattggctcctctgtcaagaatccctgcaggcaccatctcaagatttttttctgcgattgacacagtcttctttattacctttctacattctagtgttaattatttgttttctttctatgttgcaagttatttttaggaggattaatggtaagtccctgaaggaaactgttactcttgaagatggacgaattggagaaagaccagaaataatttatcatgtaattcacactattttattggg

SEQ ID NO: 6018 - DNA, 548 bp, Homo sapiens
  ENST00000522669
ctggattccttatgtgtgcatgttagcagcatttggtgtatgttctcccgaactttggatgacacttttcaagtggcttcgattaagaactgtacacccaatattgttggctcttattctgagcatggccgtgcctactataataggtctcagcttatggaaagagaaggcaagctccagttgcagctgtgtttgcagggagtccacagttaatgggtgcgattaaattatgcactggatggatggtgacaagtttgcctctttacaatgatgatgatcttctcaagagaaatgaaaatatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacatggtttgtgaagaaggtgacaagctaacctactcaaaatatgggcgattttgtcatgaggtcaaaattaactattctccatatgtgaat

SEQ ID NO: 6019 - DNA, 4412 bp, Homo sapiens
  ENST00000370192
tttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttgctgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcattttaaa

SEQ ID NO: 6020 - DNA, 1036 bp, Homo sapiens
  ENST00000474241
taagatgatattttctgacaacccacttggtctgacttgtggaatggtatgtccaacctctgatctttgtgtaggtggatgcaatttatatgccactgaagagggacccattaatattggtggattgcagcaatttgctactgagactttgatcctggctttctctttaatgaatcatttgtaaagactttgattcttcagacactcttgggctctctgacgtctcctatttggagtcaacaagcaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaaggtaaatgaaaaaaacacctatctgtgtactgctcaaaaagaaaggagtaagctctacactaaagattaacagcaaatgtcatgcattttaggaaagaacaattaaaagctacatcaggcagaagcagaaagatgcttccccttgcttagggcatttgtctgtctactgtctgaatgccactagcctggaaaagggcaatcaatagttctcatctggcatgcctgcatgtgattaattgtctgtaagaaacaaattcctaaattgctttaggggttcagtgcagctaatagaaggatttggtttctttaatcatgttttttcatgcaagttgtgtgcactctgaaacattagtatttcacaatttggaacataatttcttatggagatttattttatttgttatattcatcatgtcagtagtgtgaatgtgataatcctttctcaacacaagcagtaaatcagtgggatagaaagcaacagcttcgtattttttattattttgttaaataa

SEQ ID NO: 6021 - DNA, 1779 bp, Homo sapiens
  ENST00000306031
cgcgccgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgagactttgatcctggctttctctttaatgaatcatttgtaaagactttgattcttcagacactcttgggctctctgacgtctcctatttggagtcaacaagcaggttaattcccatgtatcatttaaatgatcagcttatatgaagggtatagtaagattttataatctttggagactagttggctagaaggtcaaattaagtgcccgtcaacctagatttttagttaatgacttactgatctggttttgtcagcataaacacaatgtgttctttcattttgggacccttcccataatattcctcaagcttaagtctcactttgctcttagtaataaatcagggttattcccttcctgctttctgacaggttaattctaaagaagagctcctgggaataagaaaataaaaacaattcgaggttgtggattgttgcaataaattctgggatttaatttcttttcttaccaaattcaaaattgcattaggcttacctgaccactacgaagtatgatctttactacctgtgaaaatccttagttgatggagaagattcacttgaattcctcctcacttttctttggggacccattgcctcttcattaaaccagggcaagctttcacagatgcagtaagtgaaaggtcacatagtatgtatatcaactaacacagcattttaaaacaaaatgaattaaaatgatatcattagtaattgatctggtcatgagaggtgtgtgtgtttgtgtgtgtgtgtgtgtgtgtgtgagagagagagagagaaagagagagagagacagggaaatacattattcctctggaaactctcacatggttttaattcttttctctgggaacactgtccctctgggaactcttacttggttctaccactcattcccagagcagagtctatttaagacagagacatgtgccttcagaacagaatttattagaaacttactaaaatttgagagtggtcacacttaggtcttgccataagtatcacctaatgaagagttatgcatagattaggactgcagtagatgcattttaagtgaatcaaggaatttagaataggaatgtatctgcttatttcattccaattatagtttgtataattgtaatttcaatatcaaattataaattaaaaatgtcctcgtgggaactactga

SEQ ID NO: 6022 - DNA, 551 bp, Homo sapiens
  ENST00000460019
acttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaaatctgcagggacctgtgcctgggcttagggcctctggcagcactaccgtcacctgtcatagcagttccaggaccagcttgacacagagcaccatggccaacaacacgttctctgtgactcccgaggccactgctgagctatctcaggtcgccagaagcctgcctaccactatgaactttcgagaacacacgtatacaattcttctctgaaccgaacaagtgcctggcaatgaggacagacctcagtggaggttgggaaggggaagcaaacagtagaacacagctttcccacctccttcacatcctgacactcagagactataat

SEQ ID NO: 6023 - DNA, 5309 bp, Homo sapiens
  ENST00000398514
ggcagatgcaaagaggaaaatcaatagggataagagagaagagggaggagtcgcagatcagccattcttgtcttatggggtcccagctggcgcagcaaaagaaaaaaaaaaacaaaacccgggcgtgaacgcgggtggaggagggtgtgcgtgggggggcgggggtgaaagggggaccggggagatttactattgtctctggcagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattac

SEQ ID NO: 6024 - DNA, 5476 bp, Homo sapiens
  ENST00000343218
tgctccgcgcgctagctggctgtgtggctcgctggctcgctagggacaagcaggaatcggagcagcactgccgcctctggcgcgaaggctcaggcgcctcctcccgccacagtcactgtggctcggcgcacgctgccggcggctgccctttccgcctctggggaagaaaaacccgcgggccgctttcgtgcttgaaccatggcctcgggccggaggggctgggacagctcccacgaagacgatctgcccgtgtacctggccaggccgggcaccacggaccaggtcccgcggcagaaatacggcggcatgttctgcaacgtggagggcgccttcgagagcaagacgctggatttcgatgccctcagcgtggggcagcggggcgcgaagactcctcggagcggccagggcagcgaccgaggatcggggagtcggcccgggatcgagggggacaccccgcgcaggggccaaggccgggaagagagcagggagcccgcgcccgcctcccccgcccccgccggggtagagatccggagcgccaccggcaaagaggtgttgcagaacctcggccccaaggacaagagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaatta

SEQ ID NO: 6025 - DNA, 838 bp, Homo sapiens
  ENST00000520473
gacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttg

SEQ ID NO: 6026 - DNA, 514 bp, Homo sapiens
  ENST00000507309
actccacctgatctcggggcgctgtgcgctgaggaaggcgcgggcgagccggagcagaagaaggagggagggagccagccgctgcagccaccaccgccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccc

SEQ ID NO: 6027 - DNA, 584 bp, Homo sapiens
  ENST00000523458
gctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccaggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcct

SEQ ID NO: 6028 - DNA, 746 bp, Homo sapiens
  ENST00000508042
aaattaaccctttgctgaccacttactgctgcaggaaaggatttgaggaaccatgatgcctaactgccttggctggttattttagacataatggtttgctattgtgtttgcccagagattctgtcctgagaagattgaggagcaaaggctttcattcagatgtcacctttgtgataaccacagaggctaaggaaaaagtacttaccctctgccagacattgctctcagatgacaatgctgtgctatactattttactagtgagggatagaggcactgggaagctgagtaaagtgacacagttaggaagtggtagatctgagatgtggatataggctatctaattccagatcctgccaaaattatccataacctttgtgcagcactgcatcctcacagttcgtggaggtgggagccaccagtttgagaggttcatgtttctattgactcctggagactttttcttgcagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccag

SEQ ID NO: 6029 - DNA, 572 bp, Homo sapiens
  ENST00000519672
gtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagag

SEQ ID NO: 6030 - DNA, 539 bp, Homo sapiens
  ENST00000512722
gcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaaggga

SEQ ID NO: 6031 - DNA, 771 bp, Homo sapiens
  ENST00000504965
agagatccggagcgccaccggcaaagaggtgttgcagaacctcggccccaaggacaaggtttattactgaggaacttggctgttggtctccactgggaaagaaacacaaggatatggaattctacttggaaaactcaggtcttcctgtttgctggataaatacagagacaaaatcacaatgagccctctcacattgatgtgaaaaaagatctttggatagaaacctactcatttattctcaggactttaagtgccctgcttcatgttttggcatgttgcaactgactttattttatttattttattacaagcaagagaaacaaagtctggttcccgtatgatttaaaaaagaaaacaaaagaaaaagacttgggttgggttaggagtttctctgaaccatgaaaatgacctcaatattggctgaaaaatttgacaagaatgaaaaatggcatggtacaagctccaggaagatgttgcagagatgagcttcagatgcatttcattttgcgttgttattaatggcttggaaagaggccataaacctattatggtaattatgtctgcagatgagggtaaataggatggtgttataaacaccagtaagcaagagacgtagtacagagcaacctagggagattagaaatatggacaggaaatgaacaaacgagatcagcctggaaaagtgaaaacatgcatctggagaaatacataatttgaaaaacagagagatacttaaaggcagggtcatacttggaaagcagtaatggtaaa

SEQ ID NO: 6032 - DNA, 2729 bp, Homo sapiens
  ENST00000338492
gcccagcgggggcgggaccggaacggagccgtgcggccccgcgcgctcgcagtctgtctcccgccgtccccacgcacgcgtcccggctcacgcgtccccccgcccgcccgcccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggagcagaagcggttgctggagctcggcatcactggccccgagggccacgtgctcagccaccccgaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacaggctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagccgcctgtgcatggaa

SEQ ID NO: 6033 - DNA, 627 bp, Homo sapiens
  ENST00000493927
cgtcccggctcacgcgtccccccgcccgcccgcccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaacacttagtatggtgcctggctcatagcaggtgcttcctaaatactggtgcccacatctattagcgcacctgcttccgtttgtcaagctgctccgtcctctagtcaaaaaagtaccaaccagggacctgagtggaaaaccacagggcgtggcgtctgcgtgaggctggaccctgcagtgaccgtcctgagctgcgctgagtgatgctttgctccctggcactcccgaggagctagtccaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaacc

SEQ ID NO: 6034 - DNA, 668 bp, Homo sapiens
  ENST00000493882
gcaggatgtccttccagggcaagaaaagcatcccccggatcacgagtgaccgccttctgatcagaggtgggaggatcgtgaatgacgaccagtccttttacgctgatgtgcacgtggaagatggcttgataaactgctccgtcctctagtcaaaaaagtaccaaccagggacctgagtggaaaaccacagggcgtggcgtctgcgtgaggctggaccctgcagtgaccgtcctgagctgcgctgagtgatgctttgctccctggcactcccgaggagctagtccaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcataca

SEQ ID NO: 6035 - DNA, 1545 bp, Homo sapiens
  ENST00000368627
gatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggac

SEQ ID NO: 6036 - DNA, 444 bp, Homo sapiens
  ENST00000471544
gggaggactgcaaggagggaggcgtgtgtgaacttgggttgagcacccccccagggcagccccaaattcctgaagctggcactggagaggcgcagagcaggcccagccctccagctgcccatgctcagcccctcatgccccatctctggccccacagctgcccaggctcagcccctcatgccctgtctctgcccccacccccccggcagctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgct

SEQ ID NO: 6037 - DNA, 4054 bp, Homo sapiens
  ENST00000393752
gtgccccgcgggaaccccgccggcctgtgcgcttgctggtgccagctcggctcgctgcctcgcattgccacaggctcctgagaggtcgcgggcagtgcctgcggggaggcgcggggccctgctctgtagggctgaaggccgcccgaggttcgccaaggctctgggctctcgaaaggaagccaagaaaagaagctgcccaggtgaccagtcctgggagtgctctctcccaaggaagctccgagcgcccaggagcccttagccggggtctagtgccctttgaacaatctccagctcttcaaggaagtgggctgccgccgcctctcttgggacctggcctgggatcctttccccaaacgcaccccggcgatttttgcgcaccgggagccgaacccctgctgcgcgcagctggctgggctcaggcgcgcttcctcaacgtttcggagccgctgcccccagcgaagtccacattccaagctccaggggctttgagagagacgaccccaaggcaaggcgtttggagagctgctgaggagccaggggcttggaggagcgagaagacatgtattttcagctgagtctcagaaggggagaatctcctgtcaccaccagaaaagcaacagccccgaaatgtgattgcaactgactagcagagcagaggcccaggagtcactggattgatgatttagaatatgctaaaaagccagtgctttatttggggaattcaggggctttctggtgcccaagacagtgacctgcagcaagggagtcagaagacagatgtagaaatcaagagtgaccatccacgggattgacttggattgccactcaagcggtcctctcatggaatgttggtgaggccctctgccagggaagcaatctggctgtgcaaagtgctgcctggtggggaggactcctggaaatctgactgacccctattccctgcttgggaacttgaggggtgtcagagcccctgatgtgctttctcttaggaagatgaggactctgaacacctctgccatggacgggactgggctggtggtggagagggacttctctgttcgtatcctcactgcctgtttcctgtcgctgctcatcctgtccacgctcctggggaacacgctggtctgtgctgccgttatcaggttccgacacctgcggtccaaggtgaccaacttctttgtcatctccttggctgtgtcagatctcttggtggccgtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcagtcatattggactatgacactgacgtctctctggagaagatccaacccatcacacaaaacggtcagcacccaacctgaactcgcagatgaatcctgccacacatgctcatcccaaaagctagaggagattgctctggggcttgctattaagaaactaaggtacggtgagactctgaggtgtcaggagagccctctgctgctttccaacacacaattaactccgtttccaaatacattccagtgtattttctgtgttgttcatagtcaatcaaacagggacactacaaacatggggagccataagggacatgtctttggcttcagaattgtttttagaaatttattcttatcttaggatttaccaaatagggcaaagaatcaacagtgaacagcttcacttaaaatcaaatttttctgggaagaaaatgagatgggttgagtttgctgtatacaaacaggtgctaacactgttcccagcaaagttttcagattgtaaaggtaggtgcatgccttcataaattatttctaaaacattaattgaggcttacagtaggagtgagaaatttttttccagaattgagagatgttttgttgatattggttctatttatttattgtatatatggatatttttaatttatgatataataaatatatatttatcatatttaataggataaattaatgagttttatccaagaccttacaaccacatttctggccatttaactagcactttataagccaatgaagcaaacacacagactctgtgagattctaaatgttcatgtgtaacttctagaaacacagcagaaactgatagataagggaataaagttgaaatgattccttaaaattcatggacacagataaatgcaaggtgagaattgacaaatgctataaatgctttctttttctgaaaagattttgaaaaatttaaaaaagtatagctactactgtgttcaaaacgttttaaatgacaaatgactttcccaggggaatttgcagttctgtaaatatcttaaataaaagccaacttaagaagagcccagcattaaatttacgatcttaggtggtaatgaaaagtatatgctgctttgtatttatgtaaaataattggccctctccatcttttctcatttcatgtgtcaggtagtttttctgaaccacacaaatggctttcctggagagagatctgtagcacagacagtgggttacagcagccccactgagggaccaaactcaaaccctgcatttccatcttaccaggtcaaaccaaaccagtcagtggggctactttttatagtgctttaatctgaatttagagctgatttttaaaggagtctttaaatgttaatggtatactaactaacgaatagtgcctcattatcattcttgagtcagatacttctgttgatgggagaaacagaagaatccttccctttgggtgtgttgagctcccccaaagccatcagcatctcttttgacaaatgctagtcctttctctgtgctttggaatcaggttcctgcatcatcacccggactgtaaaaagtatcataagcctcccttgccagatgccaactcgtggggcatttcaacagagtttctttgaaatgtttacaacgtattcttcttgataagcaatgaacttaacatttagatgcaatccgtgaaaagaaaaaaaaatctgaaaaatatctcctgcatcaggtctgtgttatttatgtattgtgaatgttttcttaattttattggctgtatgctttcttacacataataaaaatattttgtgaactc

SEQ ID NO: 6038 - DNA, 2433 bp, Homo sapiens
  ENST00000346454
agcagccggcgccgtctctgcccccgggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtca

SEQ ID NO: 6039 - DNA, 2789 bp, Homo sapiens
  ENST00000362072
ccggcagcctcacgcgcgcaccgcgccgcctccgccccgtccccgcgctccctcctgcccgcccgccccgcgcccggccccgccccgccccgccccgccgcggcccgtccactgctccccgcgggccagagccggccgagctgctgcccgccggggctctgaacggcgcggcggggccgggagccagggaccggccgaggagagtggcggccccggacggctgccggaggggcggccgcgcgtggatgcggcgggagctggaagcctcaagcagccggcgccgtctctgcccccgggcgccctatggcttgaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtca

SEQ ID NO: 6040 - DNA, 2473 bp, Homo sapiens
  ENST00000544518
agagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactctatctgggcctgggctaggggacatcagaggttctttgagggactgcctctgccacactctgacgcaaaaccactttccttttctattccttctggcctttcctctctcctgtttcccttcccttccactgcctctgccttagaggagcccacggctaagaggctgctgaaaaccatctggcctggcctggccctgccctgaggaaggaggggaagctgcagcttgggagagcccctggggcctagactctgtaacatcactatccatgcaccaaactaataaaactttgacgagtc

SEQ ID NO: 6041 - DNA, 2467 bp, Homo sapiens
  ENST00000542968
ttaagaagtgtttgttgaatgaataaataaatgatggatcagctctgttcaagctcatcttattatgcatttttaaaaaattgtgtttgctcatttgtcctaccagctgtaaaaacttgctagcaaaagagtggcagaaggcccaacatttttagaaaattcttagccgtaaaccttaaaatcccgagttggaaaattctcattattaaatgccaggagttggtcttcttcctggagacctctgcaagaggccctctcactgacaccttgtgtccatttttcctggccagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctcactgcccgcacaccctcactctgccagggcagtgctagtgagctgggcatggtaccagccctggggctgggccccccagctcaggggcagctcatagagtcccccctcccacctccagtccccctatccttggcaccaaagatgcagccgccttccttgaccttcctctggggctctagggttgctggagcctgagtcagggcccagaggctgagttttctctttgtggggcttggcgtggagcaggcggtggggagagatggacagttcacaccctgcaaggcccacaggaggcaagcaagctctcttgccgaggagccaggcaacttcagtcctgggagacccatgtaaataccagactgcaggttggaccccagagattcccaagccaaaaaccttagctccctcccgcaccccgatgtggacctctactttccaggctagtccggacccacctcaccccgttacagctccccaagtggtttccacatgctctgagaagaggagccctcatcttgaagggcccaggagggtctatggggagaggaactccttggcctagcccaccctgctgccttctgacggccctgcaatgtatcccttctcacagcacatgctggccagcctggggcctggcagggaggtcaggccctggaactc

SEQ ID NO: 6042 - DNA, 1493 bp, Homo sapiens
  ENST00000538967
atggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggtgcaggaggctgcccggcgagcccaggagctggagatggagatgctctccagcaccagcccacccgagaggacccggtacagccccatcccacccagccaccaccagctgactctccccgacccgtcccaccatggtctccacagcactcccgacagccccgccaaaccagagaagaatgggcatgccaaagaccaccccaagattgccaagatctttgagatccagaccatgcccaatggcaaaacccggacctccctcaagaccatgagccgtaggaagctctcccagcagaaggagaagaaagccactcagatgctcgccattgttctcggcgtgttcatcatctgctggctgcccttcttcatcacacacatcctgaacatacactgtgactgcaacatcccgcctgtcctgtacagcgccttcacgtggctgggctatgtcaacagcgccgtgaaccccatcatctacaccaccttcaacattgagttccgcaaggccttcctgaagatcctccactgctgactctgctgcctgcccgcacagcagcctgcttcccacctccctgcccaggccggccagcctcacccttgcgaaccgtgagcaggaaggcctgggtggatcggcctcctcttcaccccggcaggccctgcagtgttcgcttggctccatgctcctca

SEQ ID NO: 6043 - DNA, 1386 bp, Homo sapiens
  ENST00000540600
tgagtcctcaaaggagaagactggcgagcagacgagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtggtaagtgctcaggccagggacccagagccaggtctttctgcccctagggaagcccactggccatggttctgagacctcagaagctggccaatgggagaagcaccccagaaacccccaccttgcctcagctgaaggcagactcaccgtgcacacctccaagcaggcatgaagtgagacacctcggttctgcaaggcatggatgtgtacgagaaaatggttggccataccaacgtaataaaaatgataataatggctattcacatttctcaaacatctaccatatccctattatctcatcaaatcctcaccacgaccccgggaggtaagtctctttgatcgaaccgatcttcagttgacagaagaggaaacaggctcagaaagattaggcaactcacccgtctcaagagttggtgacactaagcccagacctgtgtgactctgaaatccacacctgtgttctttccactgacatgagctgccttatggatgggcaggttctggggtaggacgc

SEQ ID NO: 6044 - DNA, 529 bp, Homo sapiens
  ENST00000535984
gtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaagggcaactgtactcaccccgaggacatgaaactctgcaccgttatcatgaagtctaatgggagtttcccagtgaacaggcggagagtg

SEQ ID NO: 6045 - DNA, 546 bp, Homo sapiens
  ENST00000539420
tcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcagaccagaacgagtgcatcattgccaacccggccttcgtggtctactcctccatcgtctccttctacgtgcccttcattgtcaccctgctggtctacatcaagatctacattgtcctccgcagacgccgcaagcgagtcaacaccaaacgcagcagccgagctttcagggcccacctgagggctccactaaaggtctcaagacaccccccaaccaactccaagggtccccacctaaccattaccaagagggctcatcttatgctcaggtgggggcttgggaaacctcagcaagggttaggtctaggctaaaggaattccc

SEQ ID NO: 6046 - DNA, 714 bp, Homo sapiens
  ENST00000543292
gccagatgctgactgcctgtcagaattcagtccctacacaccccgccccatgtctgtctgtcttgcttcatggaccactcacaccccagagttccgcctgccttctctgttgcccaccaaacccgtgtgtgtttgttcgttcatatgcaagagcctggccacccagtggctccaccgccctgatggatccactgaatctgtcctggtatgatgatgatctggagaggcagaactggagccggcccttcaacgggtcagacgggaaggcggacagaccccactacaactactatgccacactgctcaccctgctcatcgctgtcatcgtcttcggcaacgtgctggtgtgcatggctgtgtcccgcgagaaggcgctgcagaccaccaccaactacctgatcgtcagcctcgcagtggccgacctcctcgtcgccacactggtcatgccctgggttgtctacctggaggtggtaggtgagtggaaattcagcaggattcactgtgacatcttcgtcactctggacgtcatgatgtgcacggcgagcatcctgaacttgtgtgccatcagcatcgacaggtacacagctgtggccatgcccatgctgtacaatacgcgctacagctccaagcgccgggtcaccgtcatgatctccatcgtctgggtcctgtccttcaccatctcctgcccactcctcttcggactcaataacgcag

SEQ ID NO: 6047 - DNA, 443 bp, Homo sapiens
  ENST00000542616
actgctccccgcgggccagagccggccgagctgctgcccgccggggctctgaacggcgcggcggggccgggagccagggaccggccgaggagagtggcggccccggacggctgccggaggggcggccgcgcgtggatgcggcgggagctggaagcctcaagcagccggcgccgtctctgcccccgggcgccctatggcttgaagtgcaggcgacggtggcggcagtagcggagggtgaccgcccggctctcggcccggctctatgatggaccgagagcccctctagggtggtatgcggagacaagagacacctctaagcaccagacagagcgcttccctatccctgtctgaggcgggcagcccttgagtgcttcctcttgaagagcagagagcctggccacccagtggctccaccgccctgatggatccactgaatctgtcct

SEQ ID NO: 6048 - DNA, 6099 bp, Homo sapiens
  ENST00000527706
cctctttatggcatgtggctggtaactttcctcctgctcctggactctttacacaaagcccgccctgaagatgttggcaccagcctctactttgtaaatgactccttgcagcagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttct

SEQ ID NO: 6049 - DNA, 6899 bp, Homo sapiens
  ENST00000321322
ggatgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaacacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctcccgatgggccccccatggatgttaccttgcagccagtgacctcacagagcatccaggtgacctggaaggcacccaagaaggagctgcagaacggtgtcatccggggctaccagattggctacagagagaacagccccggcagcaacgggcagtacagcatcgtggagatgaaggccacgggggacagcgaggtctacaccctggacaacctcaagaagttcgcccagtatggggtggtggtccaagccttcaatcgggctggcacggggccctcttccagcgagatcaatgccaccactctggaggatgtgcccagccagccccctgagaacgtccgggccctgtccatcacttctgacgtggccgtcatctcctggtcagagcccccgcgcagcaccctcaatggcgtcctcaaaggctatcgggtcatcttctggtccctctatgttgatggggagtggggcgagatgcagaacatcaccaccacgcgggagcgggtggagctgcggggcatggagaagttcaccaactacagcgtccaggtgctggcctacacccaggctggggacggcgtacgcagcagtgtgctctacatccagaccaaggaggacgttccaggtccccctgctggcatcaaagctgtcccttcatcagctagcagtgtggttgtgtcttggctcccccctaccaagcccaacggggtgatccgcaagtacaccatcttctgttccagccccgggtctggccagccggctcccagcgagtacgagacgagtccagagcagctcttctaccggatcgcccacctaaaccgcggtcagcagtatctgctgtgggtggccgccgtcacctctgccggccggggcaacagcagcgagaaggtgaccatcgagcctgctggcaaggccccagcaaagatcatctcctttgggggcaccgtgacaacaccttggatgaaagatgttcggctgccttgcaattcagtgggagatccagcccctgctgtgaagtggaccaaggacagtgaagactcggccattccagtgtccatggatgggcaccggctcatccacaccaatggcacactgctgctgcgtgcagtgaaggctgaggactctggctactacacgtgcacggccaccaacactggtggctttgacaccatcatcgtcaaccttctggtgcaagttcccccggaccagccccgcctcactgtctccaaaacctcagcttcgtccatcaccctgacctggattccaggtgacaatgggggcagctccatccgaggcttcgtgctacagtactcggtggacaacagcgaggagtggaaggatgtgttcatcagctccagcgagcgctccttcaagctggacagcctcaagtgtggcacgtggtacaaggtgaagctggcagccaagaacagcgtgggctctgggcgcatcagcgagatcatcgaggccaagacccacgggcgggagccctccttcagcaaagaccaacacctcttcacccacatcaactccacgcatgctcggcttaacctgcagggctggaacaatgggggctgccctatcacagccatcgttctggagtaccggcccaaggggacctgggcctggcagggcctccgggccaacagctccggggaggtgtttctgacggaactgcgagaggccacgtggtacgagctgcgcatgagggcttgcaacagtgcgggctgcggcaatgaaacagcccagttcgccaccctggactacgatggcagcaccattccacccatcaagtctgctcaaggtgaaggggatgatgtgaagaagctgttcaccatcggctgccctgtcatcctggccacactgggggtggcactgctcttcatcgtacgcaagaagaggaaggagaaacggctgaagcgactccgagatgcaaagagtttggcagaaatgttgataagcaagaacaatagaagctttgacacccctgtgaaagggccaccccagggcccacggctacacattgacatccccagggtccagctgctcatcgaggacaaagaaggcatcaagcaactgggagatgacaaggccaccatccctgtgacagatgctgagttcagccaagctgtcaacccacagagcttctgtactggcgtctccttgcaccacccaaccctcatccagagcacaggacccctcatcgacatgtctgacatccggccaggaaccaatccagtgtccaggaagaatgtgaagtcagcccacagcacccggaaccggtactcaagccagtggaccctgaccaagtgccaggcctccacacctgcccgcaccctcacctccgactggcgcaccgtgggctcccagcatggtgtcacggtcactgagagtgacagctacagtgccagcctgtcccaggacacagacaaaggaaggaacagcatggtgtccactgagagtgcctcttccacctacgaggagctggcccgggcctatgagcatgccaagctggaggagcagctgcagcacgccaagtttgagatcaccgagtgcttcatctctgacagttcctctgaccagatgaccacaggcaccaacgagaacgccgacagcatgacatccatgagcacaccctcagagcctggcatctgccgctttaccgcctcaccacccaagccccaggatgcggaccggggcaaaaacgtggctgtgcccatccctcaccgggccaacaagagtgactactgcaacctgcccctgtatgccaagtcagaggccttctttcgaaaggcagatggacgtgagccctgccccgtggtcccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttct

SEQ ID NO: 6050 - DNA, 583 bp, Homo sapiens
  ENST00000525836
aaagaggctttgcctcagtagctcttctcaaccccagctgccgtgagtctgattcaactgatggggcatcggtggttgttcagcctccccaggtgaactcgaagtggagcaaaaggtgacagtcacagcttagtagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagaca

SEQ ID NO: 6051 - DNA, 1708 bp, Homo sapiens
  ENST00000532982
tgcgtcttcctgactctagtacgttgaatctggccagaaaaaccacatttgctctctacgaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactga

SEQ ID NO: 6052 - DNA, 5642 bp, Homo sapiens
  ENST00000227451
ggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggagttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagcc

SEQ ID NO: 6053 - DNA, 494 bp, Homo sapiens
  ENST00000531902
ggaggattcctggactggtgcataactccgagaaaaacactgcttctcatcatgggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaagg

SEQ ID NO: 6054 - DNA, 651 bp, Homo sapiens
  ENST00000527475
tactgagtggctgaataatgactccctgtgtaggctcctgccctagagagctggtcccctcctcagggacaggggcttctcttacatatccctcagcatggagcatgggaccagttgtggaatttacctcctattactttggagaaagcagaaatagcctaggtgactgggctgggagggaaaaactaagatctatcactcaccagggtgcattttgttcccctggcccttcatctctggtaccttttgggactgggtgggaaagttattaccaaaactgtttcccaatctggctcttctggccttggcccctcaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacac

SEQ ID NO: 6055 - DNA, 833 bp, Homo sapiens
  ENST00000590343
caaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattcttttaaaatccaggcctttctgtgaccctgaagcagcccctcctcggcccccaccttccccaaacctcttagctgcctccatgggccctgccccaagctgggtgctgctggtgcccagagaggccttgacccccaagaaggtagcgggttgaggacccggggggcctcagcctgtgtgggtgtggatcagggcagcctgcctggaggaggcggcctcaaagctgttaggggggtgttgctggaagaggcaaaggcctggcccagaatcctccctcccatggtgatgaccatgtctgccaacgtctgcccctgcttg

SEQ ID NO: 6056 - DNA, 1355 bp, Homo sapiens
  ENST00000320699
agggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgagctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 6057 - DNA, 2301 bp, Homo sapiens
  ENST00000589085
aatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggcaatcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacggtgggtcttgggacgcctcgggcattggggcctcgcggtcgaccccgcgtcccttcctaatggctcctctcctcccatccctccctcttcacctccacacctccctctgtctccgcctgtgtctctctctgtctctctcagcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 6058 - DNA, 2113 bp, Homo sapiens
  ENST00000309061
gacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 6059 - DNA, 453 bp, Homo sapiens
  ENST00000589841
ccagcctgggcgacagagccagactccgtctcagaaaaaacaaaagaaagtcctgtgctttgaaggttgtgtgcatgcagctgggaggcttactaggcttgtaggttttgtggtctgggctccggctcaggccaggccatggaagcagaggccacacgatcccaggcaggctggtggctgggcccactgatcgtcacccgtcccacagtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgc

SEQ ID NO: 6060 - DNA, 797 bp, Homo sapiens
  ENST00000592468
ttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgc

SEQ ID NO: 6061 - DNA, 768 bp, Homo sapiens
  ENST00000591560
tgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgc

SEQ ID NO: 6062 - DNA, 701 bp, Homo sapiens
  ENST00000592673
gtctctctcagcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggtgggtgttccgggaagccacctccctctcccctaccacccttggtcactcacacctctgggctgttcgccttcccacttgggaccccctcgtaccaccctgatgggagccactgggtcagccaaaactcctgaagggctggtgagcagaactccagggtcccacctgcccatgtctccctgagaccccagcctctgtctcctcaggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacga

SEQ ID NO: 6063 - DNA, 379 bp, Homo sapiens
  ENST00000590087
aacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtacggccagccacatcctcgcactggctcccaaacaactcccccgggc

SEQ ID NO: 6064 - DNA, 249 bp, Homo sapiens
  ENST00000593229
tgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaaggtagcggccctggacgtgtgcctcggtttcccc

SEQ ID NO: 6065 - DNA, 977 bp, Homo sapiens
  ENST00000590110
gcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccag

SEQ ID NO: 6066 - DNA, 806 bp, Homo sapiens
  ENST00000592491
accgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggcaatcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcgggtacgtgttgaggacaacgtcagtagcagatctgtccatctggtgtgcgtctattaaataccagctgtgtcca

SEQ ID NO: 6067 - DNA, 895 bp, Homo sapiens
  ENST00000585587
ggctgagggcgagaagccaccggctcttcattccgggccgttcttccgcctgcagggtggtcagcggaggtacctgagatcgtgcacgttggggcctgtcacatgcgcgaaggacaccacgtgcatgctagggcagatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggcaatcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctga

SEQ ID NO: 6068 - DNA, 869 bp, Homo sapiens
  ENST00000590681
tcgccggggcaggagggaagctgaagggccttttccggcacccatagcgcggtccgagctgtgcatgccgggagattaggcagcggctgagggcgagaagccaccggctcttcattccgggccgttcttccgcctgcagggtggtcagcggagatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggcaatcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcact

SEQ ID NO: 6069 - DNA, 566 bp, Homo sapiens
  ENST00000589854
aatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggcaagtgcggccacgtgagcattcctgccggggcaggcaggagcagggtgtgtttcctggcagcgggtaattgttagaaagctcctgggccttcagcaacgagcagtgag

SEQ ID NO: 6070 - DNA, 2019 bp, Homo sapiens
  ENST00000239223
gcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaatttcaa

SEQ ID NO: 6071 - DNA, 5253 bp, Homo sapiens
  ENST00000298573
ggaagagaaagagtgaagaaaagttgcgagcgtctcctctcttcctaagcctcccgccccaacccacccctcagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggtgggtttgctgagttctctcgttgtttccctggcctctgtgaaggaaaatccactctagtccctacctgcatttctcagccttgcttacctgttgccaacattgggccaacccgaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctatgattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaa

SEQ ID NO: 6072 - DNA, 554 bp, Homo sapiens
  ENST00000545864
agttagtttttagaggtccaagggaaatcaggcagtgtctcatctgttgttaattaatgaaacgaaactggagtcactagagtgcagcagtgaatgaaaggtgggtttgctgagttctctcgttgtttccctggcctctgtgaaggaaaatccactctagtccctacctgcatttctcagccttgcttacctgttgccaacattgggccaacccgaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgatttgtgaaagaaaaaagacctactatatctccaaacttcaattttctgggccaactcctggactatgagaagaagattaagaaccagactggagcatcagggccaaagagcaaactcaagctgctgcac

SEQ ID NO: 6073 - DNA, 566 bp, Homo sapiens
  ENST00000539940
aaaactctctgaagtttttatttacccagcgctctggctcccacttctgttttaaaagattataagtaaatactctgctctttcaagtgaaccaaacctatcaaacctgtttagaaaataaaccaggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaa

SEQ ID NO: 6074 - DNA, 585 bp, Homo sapiens
  ENST00000541207
gttttaaaagattataagtaaatactctgctctttcaagtgaaccaaacctatcaaacctgtttagaaaataaaccaggcagaataaaatgatgcgaaatgttcattttaaaaaacttcaggatgggcacaaacacacagaagtgggaaatgaataaaagagtattgataaatttttgaaaattgttgaagctgagtaatgggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgatt

SEQ ID NO: 6075 - DNA, 258 bp, Homo sapiens
  ENST00000536236
aatgcctctttatgccactcaccttatggggctgatggagagtccacgtaaaggataaccgtttcctcaaaggatttatgctgtttcacctccatcaagaaaagggctttttaaagttaaggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggct

SEQ ID NO: 6076 - DNA, 3402 bp, Homo sapiens
  ENST00000228862
ggaagagaaagagtgaagaaaagttgcgagcgtctcctctcttcctaagcctcccgccccaacccacccctcagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttc

SEQ ID NO: 6077 - DNA, 5253 bp, Homo sapiens; identical to SEQ ID NO: 6071
  ENST00000626413

SEQ ID NO: 6078 - DNA, 3402 bp, Homo sapiens; identical to SEQ ID NO: 6076
  ENST00000628303

SEQ ID NO: 6079 - DNA, 554 bp, Homo sapiens; identical to SEQ ID NO: 6072
  ENST00000630190

SEQ ID NO: 6080 - DNA, 566 bp, Homo sapiens; identical to SEQ ID NO: 6073
  ENST00000626461

SEQ ID NO: 6081 - DNA, 585 bp, Homo sapiens; identical to SEQ ID NO: 6074
  ENST00000629698

SEQ ID NO: 6082 - DNA, 258 bp, Homo sapiens; identical to SEQ ID NO: 6075
  ENST00000627160

SEQ ID NO: 6083 - DNA, 405 bp, Homo sapiens
  ENST00000603296
aggccgtgaggtctgaggtcagagatccagccatctgctcccccagggtagggaggtcgggcctccccgggatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgc

SEQ ID NO: 6084 - DNA, 1485 bp, Homo sapiens
  ENST00000344450
gagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 6085 - DNA, 804 bp, Homo sapiens
  ENST00000603453
tttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgc

SEQ ID NO: 6086 - DNA, 867 bp, Homo sapiens
  ENST00000605315
ttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccag

SEQ ID NO: 6087 - DNA, 465 bp, Homo sapiens
  ENST00000603881
ccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttc

SEQ ID NO: 6088 - DNA, 1166 bp, Homo sapiens
  ENST00000603795
ccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctaccc

SEQ ID NO: 6089 - DNA, 3098 bp, Homo sapiens
  ENST00000419235
ccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagttt

SEQ ID NO: 6090 - DNA, 1231 bp, Homo sapiens
  ENST00000605035
gtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcaggtaagcagttcttaggggacatcagagatgcaggcaggtgcccctgaacggtgcccacagtctttccgtacacagccagcatcatggcgtttggagttgaaaggcccacagaggacatcggctcccagggcgcccagctgcaccccttcagaagtcgtcacgatccctcgtgcacctgttgaagccacaggcgcctaccctttgtcattctccttgtgcctggtactccctactagtttgtttctctccctttgggtgacgtaccatttccttggtctggcctattttcatgtcctaggccagcaccttgaaggagcagttccttctcttgcttgaccctggctggccaaccacagagctctgatttcccactgctgtttgtttccctggttatgtgtggcaccatctctgtggtgaagtcacaggtgcaagcccacgtggatgcagacgtgcacatgtgtgtgacgtttcgggtttgtttccatcctctccagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccag

SEQ ID NO: 6091 - DNA, 551 bp, Homo sapiens
  ENST00000605863
aacatgccatagtgcgcctgcgaccacacggccggggcgctagcgttcgccttcagccaccatggggaatgggatgaacaaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcaggtaagcagttcttaggggacatcagagatgcaggcaggtgcccctgaacggtgcccacagtctttccgtacacagccagcatcatggcgtttggagttgaaaggcccacagaggacatcggctcccagggcgcccagctgcaccccttcagaagtcgtcacgatccctcgtgcacctgttgaagccacaggcgcctaccctttgtcattctccttgtgcctg

SEQ ID NO: 6092 - DNA, 352 bp, Homo sapiens
  ENST00000603005
agcgttcgccttcagccaccatggggaatgggatgaacaagatcctgcccggcctgtacatcggcaacttcaaagatgccagagacgcggaacaattgagcaagaacaaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtcc

SEQ ID NO: 6093 - DNA, 587 bp, Homo sapiens
  ENST00000603726
atggggaatgggatgaacaagatcctgcccggcctgtacatcggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccgggaattctgaagttctgggcctttctcagaagactgtaatgtacctgaagtttctgaaatattgcaaacccacagagtttaggctggtgctgccaaaaagaaaagcaacatagagtttaag

SEQ ID NO: 6094 - DNA, 548 bp, Homo sapiens
  ENST00000603290
atagcagggatcgaaaactgtctagtaatcgctctttcttgaagcaagctgtatctaggtttctcgtgtggcagtcgggtgtgtaagagcggcccctccactggctggtcctgctaccacagactcacttgcaaatggagccctagaactcctgcatggctggactcagagggcttgagatcttccagtacttaactgagtctagggaggacatggttttttaaacttctaaatcaaagaactcttttggcctggcttcctagaggtaccctgtccttcagctggggaccttctctctagggctcgtgctcactgaccagcctctccttacaactgaagacttttgcaggacactcttcctagatgttgccttcatgttgagtcccggtgtctgagcatttcctcctgacggctgtacttgagcagtcacctggcacagggagttaaatacctgtgcatcccagcagcggattcaccatctcaaaacctgacaagacatttcaaagaaagtattaaattcattcacgagtgccggctccgcggtgaga

SEQ ID NO: 6095 - DNA, 547 bp, Homo sapiens
  ENST00000605391
aatcgctctttcttgaagcaagctgtatctaggtttctcgtgtggcagtcgggtgtgtaagagcggcccctccactggctggtcctgctaccacagactcacttgcaaatggagccctagaactcctgcatggctggactcagagggcttgagatcttccagtacttaactgagtctagggaggacatggttttttaaacttctaaatcaaagaactcttttggcctggcttcctagaggtaccctgtccttcagctggggaccttctctctagggctcgtgctcactgaccagcctctccttacaactgaagacttttgcaggacactcttcctagatgttgccttcatgttgagtcccggtgtctgagcatttcctcctgacggctgtacttgagcagtcacctggcacaggacaagacatttcaaagaaagtattaaattcattcacgagtgccggctccgcggtgagagctgccttgtacactgcctggccggggtctccaggagcgtgacactggtgatcgcatacatcatgaccgtcactg

SEQ ID NO: 6096 - DNA, 3824 bp, Homo sapiens
  ENST00000604971
agtgctgtatctgctggtgcctggagagtcatctgccctgggcttccgcgtcctggtgtgtgcagtgctatatctgctggtgcctggagagtcatctgccctgggcttccgcgtcctggtgtgtgcaatgctgtatctgcgggtgcctggagagtcatctgccctgggcttctgcatcctggtgtgtgcagtgctgtatctgctggtgcctggagtcatctgccctgggcttctgcgtcctggtgtgtgcagtgctgtacctgctggtgcctggagagtcatctgccctgggcttccgtatcctggtgtgtgcagtgctgtatctgctggtgcctggagagtcatctgccctgggcttccgcgtcctggtgtgtgcaatgctgtatctgcgggtgcctggagagtcatctgccctgggcttctgcatcctggtgtgtgcaatgctgtatctgctggtgcctggagtcatctgccctgggcttctgcatcctcgtgtgtgcagtgctgtacctgctggtgcctggagtcatctgccctgggcttccgcatcctcgtgtgtgcagtgctgtacctgctggtgcctggagagtcatctgccctgggcttctgcgttctggtgtgtgcagtgctgtatctgctggtgcctggagagtcatctgccctgggcttccgcgtcctggtgtgtgcaatgctgtatctgctggtgtctggagtcatcttccctgggcttctgcgtcctggtgtgtgcagtgctgtatctgctggtgcctggagagtcatctgcgctgggcttctgcgtcctggtgtgtgcaatgctgtatctgctggtgcctggagagtcatctgccctgggcttctgcgttctggtgtgtgcagtgctgtatctgctggtgcctggagagtcatctgccctgggcttccccgtcctggtgtgtgcaatgctgtatctgctggtgcctggagagtcgtcttccctcggcttctgtgtcctggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagttt

SEQ ID NO: 6097 - DNA, 536 bp, Homo sapiens
  ENST00000604914
ctgggctctggacatctgctgtcagtgcaggtggctacctgtccttgagctgtccccagtgcttctcagctttgctaggagctgagtgctctcttgtctgtgacagtgacctgatttaagcgtggagtgaccccttgcactatagacaagacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggc

SEQ ID NO: 6098 - DNA, 503 bp, Homo sapiens
  ENST00000604988
actctccagtgaagctacgacagtaagacttctgtttcagctgaaaaaggaagtcaggaccgtagctcatgaaaaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccgggaattctgaagttctgggcctttctcagaagactgtaatgtacctgaagtttctgaaatattgcaaacccacagagtttaggctggtgctgccaaaaa

SEQ ID NO: 6099 - DNA, 1835 bp, Homo sapiens
  ENST00000256261
agttaattctgtctgggaggagtgtgtgtgtttaagacagtgcctgggatgacttataatgtaatctttaggcaaaacgctttgtaattggtgcagctctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaag

SEQ ID NO: 6100 - DNA, 1373 bp, Homo sapiens
  ENST00000523956
gctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggac

SEQ ID NO: 6101 - DNA, 729 bp, Homo sapiens
  ENST00000522982
ggacatgtgactctcccacctcgtttcgtggcagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagg

SEQ ID NO: 6102 - DNA, 2557 bp, Homo sapiens
  ENST00000369583
cttatatgggcagccgcgtcacggacggcactcattcacataaaacgctgcgcggccggcggaatccccggcttctagggcggcgagcggccgggctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcgcgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtaaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaagca

SEQ ID NO: 6103 - DNA, 819 bp, Homo sapiens
  ENST00000468749
tatcctgagtgttgcgtggatgtaaaacccatttcacaagagaagattgagagtgagagagccctcatcagccagtgtggaaaaccagtggtaaatgtcagctacaggccagcttatgaccagataactgaaaccagaggaaatcaaaagatactagagggcttcatgtttctgtaaactaggtggcccagttgaaatccttcccttcctctaccttggaagtgcctaccatgcatccaagtgcgagttcctcgccaacctgcacatcacagccctgctgaatgtctcccgacggacctccgaggcctgcgcgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatgg

SEQ ID NO: 6104 - DNA, 920 bp, Homo sapiens
  ENST00000378581
taccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtggagtcttgctctgtcgcccaggctggagtgcagtgatgcaatttcggctcactgcaacctctgcctcccaggttcaagtgattcttctgcctcagcctcccgagtacctggaactacaggcacacgccataacgcctggctaatttttatatttttagtagagatggggttttgccatgttggccaggatggtctcgaactcctgacctcaagtgatccacccacctcggcctctcaaaatgctgggattacaagcgcgagccaccctgcccggccgaaaagatctcaaacattcatctcttacaagatttagatgactatcatcaatatgccttaacatcagtagtttaggagactctagcccactttgtctagttgcaaactgtaattctccctgtggtcccactgaatatcattccacagcattcttggatatatatgatgtattgacaattcaggtctagatagaaatggcccctattgcttcatgaagaatatcctttccccaaatgtcttctgaggagctcaagattaaagctagtatcctgtacagacacttgcaggactgctagtatgatatatattgaccctatgggagac

SEQ ID NO: 6105 - DNA, 2217 bp, Homo sapiens
  ENST00000378578
caaaggcggggattgcgtagggaaaggccctaggccataaacgggggtggggcctccccggaggccagtgcgcggccgcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 6106 - DNA, 719 bp, Homo sapiens
  ENST00000432389
ctcccagcgagggcggtcccaagagttggggtgcggcgtcctccgagcccgggtcctctcccctgggcccgggatccgccccgcccgacccgttctccccaccccaaagtcctgagattcggggtgggaggggtggccaggagcgcgcggatcagacggtggggtcggggcagggttgggaggacgaggcctgacttgggtgcgaggagtgggcatggggtgacgggcgccgccctcctaccgggcgggcctcgaaaacgggtcttcccgctgctgcctccgtcccttggcttcctcagcgcgggtgctgcagcccccatggctcggagtctcggggtcctggtggcactgccattcccgctcccggttggcttcaatgctgaggaagcccacaatattgtcaaagagtgtgtagatggggttttaggtggtgaagattataatcacaacaacatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggaccatgaactgtattgtcaacgtttttgccattgctattgttctttaactgactaaaaatgttgggctaaagccattaac

SEQ ID NO: 6107 - DNA, 2724 bp, Homo sapiens
  ENST00000593685
ttccggtctcagcaggcccaggagggcctcctgggtggggggcgggacgccgggtccctaggggctggtggtcactcagggtggggcgtgtcgcccctcccccgtccacctgctctactcttcccccgcgtgccctgggctgacccttgtcccctcctctccccgcccccggtggcagtggcggctgctgttgtcacccaccgggcctcctgtcccgcttgccctccccgccgcggggccggccgggccagagacaggcggtcgccttttcagcgccgccaccgccgccatgctggccgctcgcccaccccactgggggccccaccgcgccccagccccccgtgggccccgcgccagccctgacccgggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 6108 - DNA, 2535 bp, Homo sapiens
  ENST00000323039
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcaca

SEQ ID NO: 6109 - DNA, 1806 bp, Homo sapiens
  ENST00000597639
atggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtga

SEQ ID NO: 6110 - DNA, 2007 bp, Homo sapiens
  ENST00000430012
tggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtga

SEQ ID NO: 6111 - DNA, 446 bp, Homo sapiens
  ENST00000601696
cagctgcgaagtatgcatagtgttcttggtgggtctccttgcctggagggagaagaatggtgcctggctctgccctgctcccacccctttcttcgtgacatgccctgccccaacaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagc

SEQ ID NO: 6112 - DNA, 657 bp, Homo sapiens
  ENST00000600611
cgccttccggtctcagcaggcccaggagggcctcctgggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatat

SEQ ID NO: 6113 - DNA, 772 bp, Homo sapiens
  ENST00000601972
ccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtgtgggacaccccccaccaccctgatccaaggccccactaacattgatcacacacccagtggttcagtggcttcaagtcccatgctgggccactcaccctagcccacttagtttccctgtgcctcagtcgccttttctgtaaaacagtttaaataacaagactcaaca

SEQ ID NO: 6114 - DNA, 2448 bp, Homo sapiens
  ENST00000348817
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctc

SEQ ID NO: 6115 - DNA, 2724 bp, Homo sapiens; identical to SEQ ID NO: 6107
  ENST00000631090

SEQ ID NO: 6116 - DNA, 2535 bp, Homo sapiens; identical to SEQ ID NO: 6108
  ENST00000625757

SEQ ID NO: 6117 - DNA, 2448 bp, Homo sapiens; identical to SEQ ID NO: 6114
  ENST00000625388

SEQ ID NO: 6118 - DNA, 1806 bp, Homo sapiens; identical to SEQ ID NO: 6109
  ENST00000625438

SEQ ID NO: 6119 - DNA, 2007 bp, Homo sapiens; identical to SEQ ID NO: 6110
  ENST00000627034

SEQ ID NO: 6120 - DNA, 446 bp, Homo sapiens; identical to SEQ ID NO: 6111
  ENST00000629412

SEQ ID NO: 6121 - DNA, 657 bp, Homo sapiens; identical to SEQ ID NO: 6112
  ENST00000626964

SEQ ID NO: 6122 - DNA, 772 bp, Homo sapiens; identical to SEQ ID NO: 6113
  ENST00000630714

SEQ ID NO: 6123 - DNA, 2068 bp, Homo sapiens
  ENST00000543431
tctcacagcctcccgcagcggcgggcggtcagcgccggcctcatgcagctcctcccgccgcctatccgcaccggaacaaagactcaaatggatgctaaaaagccaaggaaatgtgatttgactcccttcctggttttgaaagcaagaaagaaacaaaagttcacctctgcgaaggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactct

SEQ ID NO: 6124 - DNA, 945 bp, Homo sapiens
  ENST00000539701
agcctcccgcagcggcgggcggtcagcgccggcctcatgcagctcctcccgccgcctatccgcaccggaacaaagactcaaatggatgctaaaaagccaaggaaatgtgatttgactcccttcctggttttgaaagcaagaaagaaacaaaagttcacctctgcgaagggccccactctttctgagatctacatggaagagacaaggaggagtcagctgagaaaacaggaaaatcgcctgtgaagtatgactgaggcgggatggtgtgatggaggtgtgcctttccgaaaaggctgggtggcctgaggcctgcagagagtccagttgctatcttccctgaacagtccaggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcagggaccaaataagataataggtgcgaaggtgccaactgaaagaggcgtcacacacacataagtccatgtgctcctgggcaagtcactttgtcttgttgggagctcaccttcttaagagcagcagtgaaaaactgttcccatctcttcccatagtgagatgttgctggggttgtcagcagcatacggtaaggtacaggggtctccccaggaatagtgtcagtcagacagatgcttcctttgggagagaggtagggagaaccttctgtctcttaatcgctgttttctccctggagaggtaggtaaagagcctggctgaaggtgggtgtctttggttaaataaatggtttatggcccccaggagagtcctaagtagttatttattgcaaacctcttttcctggacagg

SEQ ID NO: 6125 - DNA, 454 bp, Homo sapiens
  ENST00000537719
tcccgcagcggcgggcggtcagcgccggcctcatgcagctcctcccgccgcctatccgcaccggaacaaagactcaaatggatgctaaaaagccaaggaaatgtgatttgactcccttcctggttttgaaagcaagaaagaaacaaaagttcacctctgcgaaggaagagacaaggaggagtcagctgagaaaacaggaaaatcgcctgtgaagtatgactgaggcgggatggtgtgatggaggtgtgcctttccgaaaaggctgggtggcctgaggcctgcagagagtccagttgctatcttccctgaacagtccaggttggaagtaaactttcggttcagatccagaagccaccttccaatatcaagaactccagaatgacccaagtctttcataagaacaccagtgttacttcactcccctttgtggacaccaaggggaagaagaatacgg

SEQ ID NO: 6126 - DNA, 989 bp, Homo sapiens
  ENST00000539309
ggcgggcggtcagcgccggcctcatgcagctcctcccgccgcctatccgcaccggaacaaagcttaagtggagactcggcaaaagcaggaggccatttagtggaaaagttcaaaccgtggaaacaacaaatgaaaatgtcctttgtcttgcttgagcgatttgatcacctacatgtggtcgaatgcaaacggaatccctgcaaaccctgcactgccatactttctgccccaaagacagcccccagggcataaagatcaagctactggcaattgcagtagaaatcctaaaatcataacaggactcaaatggatgctaaaaagccaaggaaatgtgatttgactcccttcctggttttgaaagcaagaaagaaacaaaagttcacctctgcgaaggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcagggaccaaataagataataggtgcgaaggtgccaactgaaagaggcgtcacacacacataagtccatgtgctcctgggcaagtcactttgtcttgttgggagctcaccttcttaagagcagcagtgaaaaactgttcccatctcttcccatagtgagatgttgctggggttgtcagcagcatacggtaaggtacaggggtctccccaggaatagtgtcagtcagacagatgcttcctttgggagagaggtagggagaaccttctgtctcttaatcgctgttttctccctggagaggtaggtaaagagcctggctgaaggtgggtgtctttggttaaataaatggtttatggcccccaggagagtcctaagtagttatttattgcaaacctcttttcctggacagg

SEQ ID NO: 6127 - DNA, 440 bp, Homo sapiens
  ENST00000538520
gaaaagggacttgcaaaggacacagagcaagcggtttcagctgtactctgctaatgtaacagggaatgactcaaatggatgctaaaaagccaaggaaatgtgatttgactcccttcctggttttgaaagcaagaaagaaacaaaagttcacctctgcgaagggccccactctttctgagatctacatggttggaagtaaactttcggttcagatccagaagccaccttccaatatcaagaactccagaatgacccaagtctttcataagaacaccagtgttacttcactcccctttgtggacaccaaggggaagaagaatacggtaagcttcccacacattagcaagaaagtcctgctgaagtcatccctgctgtatcaggtgagtgcagacggactggaccctgagaaggcaggtgaaagacctggttttagtccaaag

SEQ ID NO: 6128 - DNA, 447 bp, Homo sapiens
  ENST00000539490
gactcaaatggatgctaaaaagccaaggaaatgtgatttgactcccttcctggttttgaaagcaagaaagaaacaaaagttcacctctgcgaagaaaggggcttcctgcaagagacgggcttatcagtgagtgtcacacagtggaagaggatatccgacggtcattcattgtctcatttccatgtctcatcagcacttcctatacgaaaagcaggaacaaaacaaaatcctgatccgaccatttggtgttgggcaaaggaatggaaatcagttcaagctgaagagacagcaaacagcagagatgtgaattgctagttctgtctaggtttttaggttggcacactattatttatggtaatgcattcacctgttaaatgcaaatggaagactcgaactagaagaacttgtaatgatcattgcaagttaacattaaaacgtttaaaatat

SEQ ID NO: 6129 - DNA, 3272 bp, Homo sapiens
  ENST00000540757
agtgtgagctgttgaaagcctgcagctaaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactctattaacatggccaattggcatgactcctcttatgagggatgggggaggatgtccttgcacttaaactcattccatatgcatctgtgtgtgtagagggggcgggtagttttgaactctcagtgttacagcatcattaatggaactccaaacaaaagaaattttttttcttcttgcccatgactgccaacctatgtcaggatttttgtttgaaaatgatagaagctgaattcaaaagcagtttaaacaacggaagacacttattgacttacataattggggcatcagaaaaggtagatgtagtttcaggcgcagcaggatccaggaattcaaatgaggttgtagggctcagactccctcttcatctattagccttgcttctcactatggttaacttcatcctgatgtcaggccctgctcagaagttaaccgccaacatccagtcaaaaagatacaggcttccttgctaacagggagtctccaaaatgattgtgacacagaaattgtgactgggatactgggatgcttggccagtctgggccccaagcccacagtgatggtgaaggcactgtgactgatgcttctctagactagagcaagggatggaaggtttcccaaaggaagggaagctaagtaaacaagcaggacatgttcactcatctaccatacgccaaatctaagtatgtcttcttacttccctttctaatcctcatctacacaaatacataatttttatgtggttgtcataggacagatagaattttacgtgaaacttaagatcataacatcagaaacaacatagagtatataaaaatagttttcttttttgcttgccatttggaataacctccccccagtacagttttcattttaattgttgcataatattttatgaagggggacaccaggtcattgaagcaatggatttggatgtaatctcccaggaaaaatcttgagttagaatagcagagggttgagagaaagtcccaggaaagacaaatatataaggagttgccagagttgaggaggtcctccaagagacccagagatacagaaagaaaattagaagccaatggagaagtttctagacagaaagaggagtcaagatagaaaattccacagaaaatccagggtaagaacagaaaatatttcttaagtggggtgatatggacattaagtcagagcagtgttagaacaggtaacttatcccagtttctatagccagaaagccacaaaaccagcaatagaactcagatccttgggaacattcttgaaacgatcttcaaccatggatgaagttggaggtggacactgttctgcagctctacagagaataagaagccaggtcttcaacattgtaatcaggatgattttgattgaataattcaaaagtatcttctgattttcatggttataaaaggttaaaatgaa

SEQ ID NO: 6130 - DNA, 1519 bp, Homo sapiens
  ENST00000536157
gcagctagtaagtagtagagcagggactcaaacccagagcccatgtgtttgttgactctgctgctctggaatctgcatttcttgccaagaactttaagaataggtttagaacaccagtgttacttcactcccctttgtggacaccaaggggaagaagaatacggtaagcttcccacacattagcaagaaagtcctgctgaagtcatccctgctgtatcaggtgagtgcagacggactggaccctgagaaggcaggtgaaagacctggttttagtccaaagccagttttagaaaggcccaggatagtggggaaaagcacagtagctgctgaagaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtgtggcttggggatgacataggccacagaggagggactgcgtgactgtggcccctgcagaatgccagcccttcctgactgtgcctctccctccaatcttcccttttgtcttcccttttctctttctacccgtctgattccatgagggggcaaagaggaggtttcaccagcaggccctgatggagctgaagatcctggaagctctcagaaagaaggacaaagacaacacctacaatgtggtgcatatgaaggactttttctactttcgcaatcacttctgcatcacctttgagctcctggggtcagctgccttttcttcttaactcattttctctggaaaagttacctaagtgatagtttttgaggtcagaacactagatttctctggatgtgaatatttagtaactagaatggacatgacagtcactcagttatccagaatgcccaggagcaaggaggttgggatgaaagcaggccatcttggtatgcctgtcacctgccagcatacccatgatgtacttccctggtgctgggtactgagccaggtgacatgaccaaaacaaggcctctttccttaagagctaaactgaaatagtcaaaaaggacatttctttgtttgcagtcattttccccactcattggctttctggcctggtcgtgcagaggctgaaacccaaaggaacaggcagctggctgctcagagtgggaaatgggttttgattttgagtaaataaggacaagagca

SEQ ID NO: 6131 - DNA, 985 bp, Homo sapiens
  ENST00000542905
agctagtaagtagtagagcagggactcaaacccagagcccatgtgtttgttgactctgctgctctggaatctgcatttcttgccaagaactttaagaatagaacaccagtgttacttcactcccctttgtggacaccaaggggaagaagaatacggtaagcttcccacacattagcaagaaagtcctgctgaagtcatccctgctgtatcaggtgagtgcagacggactggaccctgagaaggcaggtgaaagacctggttttagtccaaagccagttttagaaaggcccaggatagtggggaaaagcacagtagctgctgaagaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcaggtatgcctttggggcagtagcagggtggggaggtgcttatggaaggtcggggtgttaagagctaagctgcgctggagtgagctaagctgccaggtgtcagagtagtcaaagaaggcagccagccaagaggaaagtagaagttaagcgttgaacctctgactgtggtagtataagcaagaggctgaataggaggctgaatttcccccaaggagtggctctgggcaagggcgggatgtaccaatgcagacagaaggaagtgtctcatttgcctaaggagcccagacacaaggctcctgtcattttatggacccaggggccagcgggaaggcactgagagagtggaagagccaggagtggaaaggtactgaatactgagagcagagcaaagggtgctgaagcttgctccttcctcttgataaggaggtgttggagaggagcctctgtagggggatcttgattagaaatgcagacatgtagaagagcatggccagccaggggtctcagtccttggctgtagctt

SEQ ID NO: 6132 - DNA, 415 bp, Homo sapiens
  ENST00000536645
ctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcaggtccttcctgatccagctgcagatttgagcgtgaagcctcctgggcctttaatgttgcctttatgttacctgtctggccctgcagacattacagttctcaaagcctctcaagacggactaattatagcttaattccacgttaacttgggcaacttgccacctaaactatatactattgtcgacactaa

SEQ ID NO: 6133 - DNA, 400 bp, Homo sapiens
  ENST00000540644
tgaaggatgaggagcatttaggtaagtagagggcctagggccgcattactgtagcttgacatatgtcttttcttctctctaggaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttggt

SEQ ID NO: 6134 - DNA, 855 bp, Homo sapiens
  ENST00000545571
ttactttgcctccgcagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactc

SEQ ID NO: 6135 - DNA, 560 bp, Homo sapiens
  ENST00000536137
gatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtgtgagtttgttgggacatctctgcttctgggtttcctcttaaatgctgtactttgacacacgtttgctggtgaaagactaaggctgggagatagttataaaagtaacaagaaatgctaacaatagagctttaaagtctacaaattgcttccacatctgttgtttcatcagacatctctccctactgtgtggttgtcagggcagatgatttgctctgttttgcacgtatggaggttgggg

SEQ ID NO: 6136 - DNA, 587 bp, Homo sapiens
  ENST00000541024
aaaaaatcaatttttaaagtaaattgcattccttgggtaatctacacatggttatttcaaactgagtgtgtgtgtgtgtgtttattggggtgtggcatgaggcgagtgtgtaagacagagagcaaaagagctacagaggccactctaagcagcagcatcatgtgaccactaaagatttacacctgaaactaaatacagaatgttctatctctacagattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcat

SEQ ID NO: 6137 - DNA, 470 bp, Homo sapiens
  ENST00000544671
ttccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaaggtacagcctgtcaaataaccagtcctagtcccacagtccgggaattaatattctagaattctgtaaatctccttgtgatatttttgaagccccagttctgtagtctggaaattaaaatctttgtttttaatattctgtttaatatgctgtttaagcatttctgaa

SEQ ID NO: 6138 - DNA, 514 bp, Homo sapiens
  ENST00000544050
ccatgtggggctttgttggggtgcagatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaa

SEQ ID NO: 6139 - DNA, 1840 bp, Homo sapiens
  ENST00000010132
ccttctacagaacaccagtgttacttcactcccctttgtggacaccaaggggaagaagaatacggtaagcttcccacacattagcaagaaagtcctgctgaagtcatccctgctgtatcaggagaatcaagctcacaatcagatgccggcctcagagctcaaggcttcagaaatacctttccaccctagcattaaaacccaggatcccaaggcagaggagaagtcaccaaagaagcaaaaggtgactctgacagcggcagaggccctaaagctttttaagaaccagctgtctccatatgaacaaagtgaaatcctgggctacgcggagctgtggttcctgggtcttgaagccaagaagctcgacacggctcctgagaaatttagcaagacgagttttgatgatgagcatggcttctatctgaaggtcctgcatgatcacattgcctaccgctatgaagttctggagacaatcgggaaggggtcctttggacaggtggccaagtgcttggatcacaaaaacaatgagctggtggccctgaaaatcatcaggaacaagaagaggtttcaccagcaggccctgatggagctgaagatcctggaagctctcagaaagaaggacaaagacaacacctacaatgtggtgcatatgaaggactttttctactttcgcaatcacttctgcatcacctttgagctcctgggaatcaacttgtatgagttgatgaagaataacaactttcaaggcttcagtctgtccatagttcggcgcttcactctctctgttttgaagtgcttgcagatgctttcggtagagaaaatcattcactgtgatctcaagcccgaaaatatagtgctataccaaaagggccaagcctctgttaaagtcattgactttggatcaagctgttatgaacaccagaaagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctctgagacaaggaaggacaaggttcaaggctgtcatcactcgagcagaaaagcagatgagatcaccaaagagactacagagaaaacaaaagatagccccacgaagcatgttcagcattcaggtgatcagcaggactgtctccagcacggagctgacactgttcagctgcctcaactggtagacgctcccaagaagtcagaggcagctgtcggggcggaggtgtccatgacctccccaggacagagcaaaaacttctccctcaagaacacaaacgttttaccccctattgtatgacctttgctgagggtatgtcctgctcctttccaccagtgatttgtattaagacagcacttatattgtacaatacttcagactgttttttttaaatacataaaactttatgttaaaaaactctattaacatggccaa

SEQ ID NO: 6140 - DNA, 6727 bp, Homo sapiens
  ENST00000409762
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6141 - DNA, 6790 bp, Homo sapiens
  ENST00000409582
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6142 - DNA, 6739 bp, Homo sapiens
  ENST00000429174
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6143 - DNA, 6769 bp, Homo sapiens
  ENST00000413539
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6144 - DNA, 6796 bp, Homo sapiens
  ENST00000258104
gggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacacagca

SEQ ID NO: 6145 - DNA, 6636 bp, Homo sapiens
  ENST00000409651
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6146 - DNA, 6543 bp, Homo sapiens
  ENST00000394120
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6147 - DNA, 6564 bp, Homo sapiens
  ENST00000409744
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6148 - DNA, 6606 bp, Homo sapiens
  ENST00000409366
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6149 - DNA, 6657 bp, Homo sapiens
  ENST00000410020
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6150 - DNA, 6594 bp, Homo sapiens
  ENST00000410041
tctccgcggaggagcagcgaaggcgacagctctcttggcgcggctgcctgggagccgggcgcttgctgggtgggtgctcgggcccggtgctcccgctcccgccctgactgcgcgcctgtgtgccgccggggctgcccagccatgctgtgctgcctgctggtgagggccagcaacctccccagtgcgaagaaggaccggcgcagcgaccctgtcgcaagcctgactttccgaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcaggcgggggacagagccgggccgagacttggtccctgctcagtgacagcaccatggacacgagatactctggaaagaagtggccggcccccacggacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagtggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctcagtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccag

SEQ ID NO: 6151 - DNA, 515 bp, Homo sapiens
  ENST00000461565
ggacgtatgttgtcaagttgcatcttttctgcctccctgctcacatctgtctgtctcctctcattgcttgcctgttcggttttgtccttagaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaagggtgagccagcaggtggtgggtgggagtgaggcctgtggtcacaggtggccagtaggcacagatgcagacctgcatgcccacagacacatgcatgtgtgcacacagcatgcacagacacctgggactcactggaggtgctcacagatcacacccagcatacccaaagatcacaccc

SEQ ID NO: 6152 - DNA, 669 bp, Homo sapiens
  ENST00000475076
cagatggtccagacggtgaccagagcagtagggagccagtatgagttgttgacaagaagagtgctctggtcagagctaggctttaggaccatcagtcaagcagccatggaggatgcttgggaggcagagcctcccatcaggaaaccccaggagtcttgtgtagagatccaggagagggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagaga

SEQ ID NO: 6153 - DNA, 3399 bp, Homo sapiens
  ENST00000479049
agactgtcctgagggatcactgaaactaggcgtgaagtcagcagccatgggcgggtgatggattgtaattcacctgtgacttgcctatgatacatggaagagaccaaagtggcaaagccccgagtcctgggacagcttggctggcagagagaaccagaaagggaggcggtggcttcagagggcagatcccacagacctgcagctggaggaccagagagttttggaaggtttagggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccaca

SEQ ID NO: 6154 - DNA, 564 bp, Homo sapiens
  ENST00000493767
gaaatggagcaggcgacagtttgggtagtgggcaggagggagaggagagaggcacatggagaaatttgaggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaag

SEQ ID NO: 6155 - DNA, 600 bp, Homo sapiens
  ENST00000472873
agtatgatgtgaacccgaataagtagactgaataggagtagggctgctctgggtgaagtgtctggaggaatgggcacagtgccagcctagcatcccttctaccctcaaggaatagaggctgcaaaccatggactgtctgatcactgacatagtccatgagtgtcatgagggtgatgggggccttaggtgacaagcacatgaccagagctctcttttcttcactccagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtca

SEQ ID NO: 6156 - DNA, 538 bp, Homo sapiens
  ENST00000494501
agactgaataggagtagggctgctctgggtgaagtgtctggaggaatgggcacagtgccagcctagcatcccttctaccctcaaggaatagaggctgcaaaccatggactgtctgatcactgacatagtccatgagtgtcatgagggtgatgggggccttaggtgacaagcacatgaccagagctctcttttcttcactccagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgcc

SEQ ID NO: 6157 - DNA, 595 bp, Homo sapiens
  ENST00000487180
ctagtgcgccttgatactaatagagaactttttccccttccaacccctctcaccatctcctggatgtgccacatcccatggctgtgggccaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcga

SEQ ID NO: 6158 - DNA, 778 bp, Homo sapiens
  ENST00000468173
agatgataacccggaagggtctgagccaggaggcaggagaaccaggctggcgggcaggcacatggtcctctctgggactgagaggggctgaagtggatctgccaggatggaataggcagtgtgtgcacgcatatgctgttctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccagcttgcagacggtctgtcgagcttggcccccactaacacggcttctcctccatccagtcctcatgaggaagagttcatcgattggtggagcaaattctttgcctccataggggagagggaaaagtgcggctcc

SEQ ID NO: 6159 - DNA, 1709 bp, Homo sapiens
  ENST00000476058
tgacacaatcacttataaaggatctaaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaa

SEQ ID NO: 6160 - DNA, 3295 bp, Homo sapiens
  ENST00000377630
aacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgtaa

SEQ ID NO: 6161 - DNA, 3739 bp, Homo sapiens
  ENST00000357236
aatctttattcccaaatatctgcaaagcctccccactgtgaagagtcaattagatccatctgagaaggatgtgtgacgcttcaggcactgggtgtgagcatcgataagaaagattcaaggagttaggccagaggatgggctagcctacagtaaggcggccaacccagaggtcttggtcacagggatgttgttgggattgacagaggaagtttataggggtttcacttaagcttgaccatgaacctgatgctagagaggaggttggtagatgcaggcatgggtgggactcaagtgtgatcaaggcaaggatctacactgggcaggggccgccttcgggggctaagccaacatatgtcagcaagtgcttaggcttgaatcaggtgtgagggaccaagtccatggagaaagtccagagagaagagtgtttaaggactgtgtgtgggcaggtggtgtgcagaagtctgattttggtctgactctaccctgcctttgccctctggacttggtggtccctctgttgttacccagactcccacagttgtaacatcctgcctgcatgtgctgctccctgcctcctgccttggccacttcacctggtgagggctacatccagatgtgctgccagctgagcagcccagtccagatacaaagctgcatgtttccagaataaagtgaaacaggggtcactttgtacaaatgaccataaactctttcaaataagaaatgcacaccatgacactttctctatcatgcagctttaattctcacatgggaataaccaagtgattgatatgcaatctcttcattcctaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgt

SEQ ID NO: 6162 - DNA, 3310 bp, Homo sapiens
  ENST00000358866
agagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgt

SEQ ID NO: 6163 - DNA, 3538 bp, Homo sapiens
  ENST00000608192
gagaggctggcgactgggttgggcgcggcagagatgcattaggggtcccgatcccgggccccgcggttagaggaagaggagggcggctagaggaggggaagagcttcccttactccagccgaaaggatgcagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccaggcaagacacagtcccatttacatttaaaagttttctgtttggccacagtatggagattagaccatggaagaggaaagggagaacattatttaggaggcttttgttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccactta

SEQ ID NO: 6164 - DNA, 3145 bp, Homo sapiens
  ENST00000609267
aatgtcaatgcccatcggacgcacaagcctggttccttcattctgagttgggaaaccaacttttagcacttggcaactctgtgaaggaatattcttagatgcctatgggaaagcactgggaaaggaactccaggcgggtaccaggctccctgcggagcggcaggggccggtctagttgctaagaagctgagtctccaccaatcatctgcccagcacccagtgggcggggcgcggctcgccgcgtctgtggtaacccgggcggcggcgaaggaggaggcaagaggcgttttgctgcatttaaattaagtgctgctcttcagcttttgtgtacattggaatttatatgtatatatatatagagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaaggtgaggaaactgaggctcagagaagttaagcaacctgcttcttccaagggcactaagttagtaagtggcagacccaggattcacacttggcagcctgagaccttcccatcatgacaccctaattccaagacattgaaggactttaagcagagaaatgacacaatcacttataaaggatctaaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctc

SEQ ID NO: 6165 - DNA, 837 bp, Homo sapiens
  ENST00000480488
agatgcaggaaagtatgttagagaaaatgttggtgaccagtggctgagtgtggattagtagtgaagtctatgctctattggattacagagctgaaaaggatagatatcttccaggcatcaagcaggccggcaaacaccccttgatttgctgacttttagataataaatggctaatcctggatcaggctggaagttgctgagaaagacaggagcaaggaagatgaggcaaaggctggaaaaccctattagttccaaccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagctt

SEQ ID NO: 6166 - DNA, 3156 bp, Homo sapiens
  ENST00000460891
gaggcggtgagaggctggcgactgggttgggcgcggcagagatgcattaggggtcccgatcccgggccccgcggttagaggaagaggagggcggctagaggaggggaagagcttcccttactccagccgaaaggatgcagttttgctgcatttaaattaagtgctgctcttcagcttttgtgtacattggaatttatatgtatatatatatagagagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggtaatgaaatgtgattctgtaaaaacatgaatgaaatacatagtaatgtttgaacaggtatatgtcctttttcagctagtgggatggggtaacaatttttttttttttttgagacagaatcttgttctgtcacacaggctggagtgcagtagcgcaatctcagctcactgcaacctccgcctcctcagttcaagtgattctcctgcctcagcctcctgagtagctggaactacaggcgtgcaccaccacgcatggctaatttttatatttttagtagacatggggtttcatcatcttggccaggctggtctcaaactcctgacctcaggtgatgcgcccacctcagcctcccaaagtgctggattacaggcataagccaccatgcccgccaggatggggtaacaattgataagctaatatacatgaacaaaatccattctatttttagtaaggtatgctgtccaagagtttaatttgccaataggatctataatattaagagagatatgtaggattgtattccctgaacatggatttggagggcaaattgcactacagctaacaaagacaattttttacttcatatatttaaactccaacattgcagttagtgttgatttataattttgtccttaaagtggctcatacttttgtttgccttatttgattataggttcttgttatggagaaaaagaatgactagaactagtcacatggaagaaaaagttatgtatcatcacttacatccaaaaaactttgctcaaaaaatgatatcatactgtgaacatttttttgatagaatctttaaacatacaactaaatattttctccattcttcaatttacagtcccatttacttcctctttaatcccaagtaaaggtcactagaggataaaatagatttaatagagggaatttgggggattaaaaaactaagaatttttagcaataagggaaatgcatggcattatgtacaggccataacactcctaaaatggccttgtgggttgtatatgggcaaaatgtattcagagaaaagataaatccactttttctttcaccttcaagctccctttagcatgaagagttcacaagtgtacaaggctgtgtgagccttcagaaatgagattttgaataactggccaggccaaagtcagtttcaggacatctagggaccgcagtgctggactagaaaggaacacttgagcaccactggtcattatcaatggaaaaagattgtatcctgagagaatagtggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagccccgatgtgcctggcagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaaggtgggtgagatgaaatttccactccacaagtgtccacgggatcaggctgaaggaaccctccatggactttgcctgaaactgcatcttgcctggctcctttccctttcctgctctgctttctacactttcttactcttctgccttgtgagctctgctctaataaatcacttgcacatgaa

SEQ ID NO: 6167 - DNA, 464 bp, Homo sapiens
  ENST00000470526
ctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagccccgatgtgcctggcagtccctgaatattcctttgcccagatctgatgttgggactaagagggacataggaacacagactgttggcctcttctacccatctggcaagctgctagcaaaaaaggaacaggaact

SEQ ID NO: 6168 - DNA, 3498 bp, Homo sapiens
  ENST00000262547
agatgcctatgggaaagcactgggaaaggaactccaggcgggtaccaggctccctgcggagcggcaggggccggtctagttgctaagaagctgagtctccaccaatcatctgcccagcacccagtgggcggggcgcggctcgccgcgtctgtggtaacccgggcggcggcgaaggaggaggcaagaggcgagagagagagagagagaaaatgactgctggttcagtgtgtgtccctcagatcataccattacgagtgcctcagcctggaaaagctaaccatgaaattgataacaatacgcttttggaaatgaaatcagacactccagatgtcaacatatattatactctggatggcagcaaacctgaatttctaaagagaattggttatggggaaaataacacatttaagtatataaaacctattactctgcctgatggaaaaatacaagttaaagctattgctgtctctaaagactgcagacagagtggcattgtgacaaaggtgtttcacgtagactatgaaccaccaaatatagtctctcctgaagacaatgttgaaaatgttctcaaagattcttcaaggcaggaattcaaaaatggatttgttggatcaaaactaaagaaaaaatataagaactctgaaaatcaacgcagctggaatgttaaccttagaaagtttccagagagtccattggaaatcccagcttatggtggaggatcaggttctagaccacccacccgccagtcccagtcccccggttttgcacacgtaagcggtcagaagtgtttgacaagcacggagataatgagaattcaaagggagacagactttctcaagtgtgcccactgccttgccccccggccatcagatccctttgctcgcttctgtcaagaatgtggctctcctgtcccacccatatttggctgtcgtctcccacccccagaaggagctcagatgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagtcgatgtgcagtggggataaagcccctcctccgcccactcagaaaggggggaccatttcctgctacagatgtggtcgctggaatctctgggaggcgtccttctgcggctggtgtggagccatgctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttagccctgaggcctccacgggacttcatttaagaatacgtgcatggctggcacagtggcttacgcctgtaatcccagcactttgggaggctgaggctggcgtatcacctgaggttgggagttcaagaccagcctgaccaacatggagaaaccccgtctctactaaaaatacaaaattagtcgggcgtagtggtgcatgcctgtaatcccagttactcgagaggctgaggcaggaaaatcgcttgaacccgggaggcagaggttacagtgagccaagatcgcgccatcgcactccagcctgggcaacaagagcaaaactccatctcaaaaaaaaaaaagaatatgtgcagctctggctattctttaatcatgtctttctgaaatgtgtatttgagattagaaattgaggttgagaggaactcaggagattttttttttaaatcatatgacagtataagccatcagtactaaatggacagctcccagtatactgtggactgtgataaactgaatgtatgttttttaatggtttattgctgcaggttttttgtgtatttgatttttagtttttaacttatttttcaataggtaataattgcacatggttcaaagctaaaaggtatgaagtattatgtagggatacgtccctcccattctgtcccacagccaccacctctctcctcagccagcaatgacatcagcgtcgacttgcctttcccggggttgtgcagagttagatatgcacatacatgtggtataagcacatgtacagaggagtacacatagcatataaacatgtctgtagcacatatatattctttcccctcttttaaaacaaatggtagcaaaccaaccacacactgttctgtatcttgctctgtttgcttgatacatcttgtaagtggctcctaattactatgtaaagattgaccttatttaaatttttttatgttgaaatcatcaatattcccatcattatggtgtgttctttgattgacaaatcagctctcaataaaccacttataagaatgtgt

SEQ ID NO: 6169 - DNA, 1389 bp, Homo sapiens
  ENST00000329494
atgggcttgtgtgcagaatgcagaagcttggtacccatgaacactcccatctgtgtggtgtgtgaggcccctcttgctctacagctgcagccacaggcaagcctccacttgaaggagaaggtaatttgccgggcctgtggtacaggaaatcctgctcacctgagatactgtgtcacctgtgagggggccctgccttcatcacaagagctcggcattcctgctggctgttctgtttgccctaaatgtggggccagcaatcacctgtctgcccgattctgtggctcctgtggtatttgtgtgaagtccctagtgaaacttagcttggacagaagcctggctctagctgctgaggaacctcgccctttttctgagtccctgaatattcctttgcccagatctgatgttgggactaagagggacataggaacacagactgttggcctcttctacccatctggcaagctgctagcaaaaaaggaacaggaactagcctctcaaaagcagaggcaggagaaaatgagtgaccataaacccctcctgacagccatcagcccaggaagagggtactggagaagacagctggatcacatctctgctcacctcaggtgttatgctcagaacaaccctgaattccgggccttgattgcagaacccaggatgggaaagcttatctctgctactgtccacgaagatggttgtgaagttagcatcagactgaattatagtcaagtctcaaacaagaacctttacctgaacaaggcagtgaatttcagcgatcaccttctgagcagtgctgccgagggtgatggggggctgtgcggcagcaggtccagctgggtgagtgactacagccagagtacctcagatactattgaaaaaatcaaaaggataaagaatttcaagaccaaaacttttcaagaaaagaaggagcagcttatacctgaaaacagactcctgctgaaggaagtcggacccacgggggaaggaagagtctctgtgattgaacagctgctggatgagggagcagaccccaactgctgtgatgaagacaatcgacccgtcataaccgtggctgttatgaataagcaccatgaagcgattccagttctcgtgcagagaggagcagacatcgaccagcagtgggggccgctcagaaatacagctcttcatgaagcaactctgcttggccttgcaggaagagagagcaccgccactttactgggatgcaatgcaagcatccaaaagaagaatgcaggaggccagacagcatacgacctggctctgaacactggagatgaccttgtcacctcactctttgctgccaagtttggccaagggcttgaggaccaactcgctcaaactaggagcctcagcctggatgactgttag

SEQ ID NO: 6170 - DNA, 3493 bp, Homo sapiens
  ENST00000327532
caagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcagcaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcagtcaaaagccagcagagcacactggtcaccagagaggcccagccaaagaccaggaccctgcaggtggccttgccatccacaccggcagagccacccccaccaactcgtcagagccatggcagccatggctccagcctgacccaggtgtccgcccccgctccacgccccggactgcatggaccctccagcacccctccttcctcggggcccgggatgagcacgcccccgttcagttctgaagaggactcagagggagaccgtgtgcagcgtgtgtctctacagcccccaaaagttccttccaggatggtgccccggcccaaggatgactgggactggtctgacacagagacctcggaggagaatgcccagccccctggccagggctcaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcagctttctgaagatgagagtgacttggagatctcctccttggaagatcttcctctggacctggaccagagagagaaacccaagcccttgtctcgctcaaagctcccagagaagtttggcactggtccacagagctctggccaacccagggtccctgcctggtgattcaccccagaagctagctggctagagggttagcctggctggggccagctcaggtccacttcaacagaagaggctgctgggcctcttgtcttcacaaacaaccaagagatcatcctcttggagagaagcagtgcagggaatggatatgatctcatccctcctgacctgtgaggggccctgctgtagatggccacaggtgcctgactaggagcccctaggtccccaggcttgagaaagggttaaaatagaacctccaggtagttttcttcctctacctccacatccccccaagactgaaaagagtcactaactctcttttcccaagccttttataaaactgcaggaacactgtggagatggttcctatctggggtccttttggggacatatgcctcagtcagtcattcagtgattgatccaaaattatttactgagtgcctacctactctgcgccaggctctctagcctctcactactgagttagggtgcaggcagaggctggggcagaatgtttacagccagtgccagcacaaggtagtaatctagtgacagagaacagggtgttatggggagcatatgagaggccatctatcccagcctgggtgatcctggagagtttcccagggttgtgatatgtggcaggcctactcatgggtgggaagggaggatggccacttggctggaccttgtatccccaaaggaccacacgtgtaatttttgatattatttccaaaatcaggttttatacatagccattgtatatttttagtgtgaaaaacattaatatattatatgcaaacatttaaatatagtacaatgtttttaa

SEQ ID NO: 6171 - DNA, 475 bp, Homo sapiens
  ENST00000486487
acagcccccaaaagttccttccaggatggtgccccggcccaaggatgactgggactggtctgacacagagacctcggaggagaatgcccagccccctggccagggctcaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcaggtaggatgtaggatgcttagagtttactctggaattctctacagaaccagctctgagtttggggggcctggggtgaaggttggggagggcccagcaagtgtcatcctttgccctagtgggacattgtgggtgacctccctctgcccctgtgcacatggagagatggccagtttggaatacttgtatccaagttaacattaaaaagccttttggttcattatataa

SEQ ID NO: 6172 - DNA, 561 bp, Homo sapiens
  ENST00000488595
tttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaagtcaaaagccagcagagcacactggtcaccagagaggcccagccaaagaccaggaccctgcaggtggc

SEQ ID NO: 6173 - DNA, 2107 bp, Homo sapiens
  ENST00000469243
aggtttgtaaatgattgcctggcagccaccttggaaacttggctccctcaagttctcctcttgactgcattcttgaggaagcagaagagacagacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcagcaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcaggctgaagaggaggaggaagaggaggggttgctcttgctgtctcacgggtggcagagtcggaagaaaatccacgtataagtggacccatggctgttcaaccccacgttgtttcggggtcaactgtatttcaaacattttctgatcttgaattactgtaagaaactcattttacattgtgaccc

SEQ ID NO: 6174 - DNA, 368 bp, Homo sapiens
  ENST00000466301
ctcaaagcagagttctcacaatgttctctgctggttgtaacccgctctattccacctctttgcagatccagtccttgtctctcaggaaggtggaagggatccacaaggtgccaaaggctgtggacacagaggaggactctccagaggaaggtgggaccttactttctttcctgggtgtccagtgcagaaacagatttgctgccctcctccttgtttagtttgtctctacttaactgtatctggacatccgaagctggagtggagggatctaaggacatgaaataatatttcttaacaccttctgtgtgccaggcatgtgacatgcaggtactaacatacaatctgctggtttagtgatggggaagccc

SEQ ID NO: 6175 - DNA, 572 bp, Homo sapiens
  ENST00000473850
ggagtcctcagggagtggcctggggtgagaccctcccataggctctaagagtctcattctcatcagtgtattccagactgaggaagaaatggggcagcagtcaggagagctcgggattttgagtatagcagaatttaagtgaaatggaaactacactctttaatttgttcttccatggaattgctttttctatgcaagggctgagcccccaggagagcccttgtgaagggaatgctgatttgtgtgaatatctgtaggtgagtaggtatctagtgaggatgagttgggaggatgagttgggtaaggcgtgcccctctgacactgttctgggtataaaagacaacatcatgatgagatcttcatctgaataaaactatgccctggccttttcagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggc

SEQ ID NO: 6176 - DNA, 708 bp, Homo sapiens
  ENST00000490472
gcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagaggtacccaacataaaaggctttttaaagtttc

SEQ ID NO: 6177 - DNA, 571 bp, Homo sapiens
  ENST00000467030
cccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttg

SEQ ID NO: 6178 - DNA, 827 bp, Homo sapiens
  ENST00000492010
aaaccggggcaagtccagcctctcagcaaggccaggaagccattcacttggatcctggattttactaacggattaaacgtggcattcccgccttcccccatccgttacagacctaaaaatagctcgtccgagaggggccgggagaggctccacctcttcttgaggtggggcggggcggctgtagtaggagctggaggcaccagagaccccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagca

SEQ ID NO: 6179 - DNA, 4749 bp, Homo sapiens
  ENST00000346618
aaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggcaaagcgaaggctggagctaggagaaagcggtcatcagtacctctcagatggtttaaaaacccccaagggcaaaggaagagctgcactacgaagtccagatagtccaaaaactccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagttc

SEQ ID NO: 6180 - DNA, 4425 bp, Homo sapiens
  ENST00000535432
accgccaccctccctctcctctccccacccccccaccggcgcccgccctcgccctgcgccgccggtctgttcggccctccgggccccctctccagccggccccccacctccccccggagccaggctggtttcggaaatgcccttacagcagcaggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagtt

SEQ ID NO: 6181 - DNA, 4094 bp, Homo sapiens
  ENST00000613242
gccatttttcagctgccggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactccgactgcaaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccccgccggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagtt

SEQ ID NO: 6182 - DNA, 4695 bp, Homo sapiens
  ENST00000519890
attgggtagatgcaataacagtgcacttcacagtgaactctgccagcaccgcgggcagtcatggggagaccccatcttggggttctgagtcttggctctgggagagcccctctcccccacctccttctttgagcagggagaggttaagcctggccattaacccataggtgacccaaatagaattatctgtcccagggatccgttgattgccagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtga

SEQ ID NO: 6183 - DNA, 4735 bp, Homo sapiens
  ENST00000519739
taccggcttcagcttctctacagcaatggtgaggcccgggtcgggtctatggcctcaccctggggctccgggtctgggcagggggcgcagggagctccaggtggacgaaatcctccagcgaagggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtga

SEQ ID NO: 6184 - DNA, 5127 bp, Homo sapiens
  ENST00000518836
agcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtga

SEQ ID NO: 6185 - DNA, 5250 bp, Homo sapiens
  ENST00000313708
gccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtga

SEQ ID NO: 6186 - DNA, 602 bp, Homo sapiens
  ENST00000518323
tgcaccagcaccaacgggaacagcctgcaagatcagtcttttgtggactctagcaagttctccagtgcagggtctctcccgggactggccttctcctgaacgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaag

SEQ ID NO: 6187 - DNA, 2345 bp, Homo sapiens
  ENST00000380654
gggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaagctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaa

SEQ ID NO: 6188 - DNA, 2277 bp, Homo sapiens
  ENST00000517373
gccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaagctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcaggtagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatattt

SEQ ID NO: 6189 - DNA, 1911 bp, Homo sapiens
  ENST00000522192
tcttttgggagagagggagcagtcaggaacagggggcggaggagggatcacaattggccacaatttctgctgctaccgtggctgcctggctcgccagcgggggtcccggcttggggaaagttgcctcgaaagttggtccactcgctcacgcagacctctctcctgcatctcttgtgtctttgcgtcctgatgcaacccaggaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttg

SEQ ID NO: 6190 - DNA, 766 bp, Homo sapiens
  ENST00000523464
tgggaattatggttggtttgggtgtcttctgaacttttggtactaaacatttgccatctgtaaacacttactggacttacaatgattggagaagacacaggcatgtttgtagcaaagggaatataggacagctccaagatccggggcggcttatagtctttgcggaggaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggtgaggatactgcctttttgtaatt

SEQ ID NO: 6191 - DNA, 490 bp, Homo sapiens
  ENST00000523315
agagcttgaggggttcctggagggtggctgctgcggcgagacgccgagcatgttttccatccattcccacctgccctgctagctgagacgtgagattcgaggggtgccggaatataactgtgggttctactccgcgaagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcag

SEQ ID NO: 6192 - DNA, 4430 bp, Homo sapiens
  ENST00000622875
tgtttcttcacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtgatggc

SEQ ID NO: 6193 - DNA, 5145 bp, Homo sapiens
  ENST00000520164
attcatggggcccgcgcgcggctgcagccgggctccgtggcgctcgcagccaccgcctcctctcggctccaggtcttccccttctttttacaactgatcctgttggggattttttttttttctaaattggaacggtggggaggagcagggaggggggacctggaggaaggggagagattaggcagccatcaatttcctccagtttctcccagaacaggtgatgcttctaaattgtgatcactttcaggaggcagcactgcagctggaaggatgcgagcgacctagggtggagtggctgaggcggcagatctgaacttgcggaggataagaacccaaactttgactacatcagtccgcacctcgccagtgaagcaaaggacgggttatcttttttttttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacagattctttttaaaatttttcctcaagtgcaatcagaattgtttgaaaacagcaggaaacccaagggacatgagacggtttcaggttgtgttgtcaacaacggtgaatgtggatggacacgtcctggctgtttctgacaacatgtttgttcataacaactccaagcatggacggagagcaagaagactcgatccatcggaagctaccccctgcatcaaagccattagcccgagtgaaggctggaccacaggaggagccatggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaatcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcagaaatgcaattctttgttatgaacattatgaaaaccaccttcctatgtttgtaaaatatttaagaaaaaattggcaaacaattaatgcttaatattttggatactatttgtttttctttgtaggaaaaaaaagttgaaagtttctattttctatgaagcctttcagataccaatttagtttatgcagaaaaaaattgaacaaaacagggtaccagcacggaagactttcttaaaacgcaacctgaattgaatgatgaaatgttgtatgtgtgtttgcttatagcttaatctctttaaaaaatgaacaaaaaaagggaaaaattttaaaatgttttacaattatttaaataaataaatgtgtaacttattgtaagtagaggtagaaattaagacctttttttggaagagagagggatttctcttcctgatgtaaaatgaaaatgatgcaaacatgtagtaacaagttttaaaggtgtgtgattattactgcagttacttactagattcttatcccctgtcctgcaccccctccttttccatcactttattgacccaagggcaagaacatgtagattcccacagaacaccctaatgcagaaacagacactctagcacatgcacaaatactccaacccatcaattcattcccagctccgtctgatttctaaatagtccacactcttgtgaatactttttaaaattcctattattagctttcaacgttctcccctgagcagtccagagaattcccatgtttgagtctgtctcaggctttcagcatcccaaggaaagaagcacctcaccttctagcagagccaaaaccacagactttcttaaccaagggaccccttgggaattcctcctcaccagaaccccaccactccctccgctttgggtgcctggttcagtacagaggtacacagccccatagaacttcagcaacacggtttggagaagataactctgtttgatggactctttagagtcagtcttagaacatccaagtcctttcctctccctgtcaatttccccttttatggcattaaactctcttgaaaaacatagctatgccactcgacagtttctagtcaagaatgagacggaatgtgggagagggatattaaaagccctaatcccctcttctgatgttcgaagaaaggcaagaccagattcttgggagatccagagattaggggcatctgcgttctatgcagcacagttacccagccctttgatgggctcttcatcgttttgtgactagctcttagaggggaagaaccttgccttagctgctaacagtggttgattcttgaaagcttatgtaatcctagagacatatccaggcatattgggattgccaataaagatgtcacttgtttccacgttggggttctccttattgactcatgagcaccacaatagagtctatacacagacttagtttggggttcttggttgggatttcagcattagaaatagatgcagcactcatggaaaaacatcatgagtgcatctgagccaattttagatgatttcattaattctgcataccttctctttgacccattgatgcaggcccacatctatccagccccaactgtcttatttgcctttaacccattctggaattacccagtatgacttatattatttctatgcacatgagaatccaaggttttagaaacctggcatgcttataactactgctgacagtccctcatagtcagggcttaaagcgccaaaatacacggaaacataagagaaaaagtcccccagtgagaaacctgattgatggaaggggaagaatgtgtggaatatgaatgttaccttccaaaagtgaaggcagagcaaaattaagcatgtttagccctggatttgagccaatccaacataaggaaattttgttttttttaagtagcattgcttttagaacctgtgaattttccttttgcatgaagatgagtgcagtactgtcttcaaaatgattgtagaatttcttggtagctttacaccgaaaaatgcgtgtaactaaataccagacatcttgaccattcagctagaaccctggcagcaacagagctatttaattgtacaaatgtgtgtaaggattatttttagtgtactaataaattaaaaacaaagctaccctgtcctcgttagtcattgctattcaatcattccagtcccaagttatttttgtgccacttggaatatgagtatttctattggtaactacaaactctatcctgtgtttgtaagaggagctgtgtaagatttttttcatttaaagggacaatttacttcattatttatctttcttttgttatagcgttgtaattcttctcagtttttctttgcacatttcaatatgcatggtttaaaaaccattaacttctctaccttttgtacagtaaggtttcattttcacactgtatagtttcattttattgttttgctttgtcagttatatacagtataaagttgctatgcacagagctttttgtaaagacagcttttttgtttactgtttttaatggtcttacttaaagaatatcttgtttgtaaaatgaatatgtctacttcagttttaaactttaaattatcctaacaaaaaaataaaatttttgtactgt

SEQ ID NO: 6194 - DNA, 1888 bp, Homo sapiens
  ENST00000408929
gcacttcccaaagtccctcctgaacctggaactcagtccctgagctcgtggccctgcgtgcgcagtcctcgcgggataggcccgaatgctgcctttccaaatgacaagtcccttcacttttctgccaagggaagccttggggcttcctaaggacagacagagcccgatgggttgggtggtgcctgtttaaaggcagctttggaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacagattctttttaaaatttttcctcaagtgcaatcagaattgtttgaaaacagcaggaaacccaagggacatgagacggtttcaggttgtgttgtcaacaacggtgaatgtggatggacacgtcctggctgtttctgacaacatgtttgttcataacaactccaagcatggacggagagcaagaagactcgatccatcggaagctaccccctgcatcaaagccattagcccgagtgaaggctggaccacaggaggagccatggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaatcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcag

SEQ ID NO: 6195 - DNA, 2505 bp, Homo sapiens
  ENST00000517825
gatgcttctaaattgtgatcactttcaggaggcagcactgcagctggaaggatgcgagcgacctagggtggagtggctgaggcggcagatctgaacttgcggaggataagaacccaaactttgactacatcagtccgcacctcgccagtgaagcaaaggacgggttatcttttttttttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacaggtagggggaaaaagtgatttttcaatcatttttggttccttttcttcatgaacctcaactctgagtactgatccatggagctttgctgtcaagttggtttcatgttatttcaagtcactaagctcatccaacaaaggcctcctcatgctggcctttcttggaagaagccagaatcttcctttggaacacgtgtctctaaatctgtggtggagtcttttccaggtgcaccagcttcagcctaataagtagtatgtgtggtgcaggatataagcgatggcacctctcctttcgggcagggtatggtctcaatcagttttctagaagaagcaatgtgccccaagttaagtggcacccactttattattctcggtgattgctgcttggctggaagattatcaattcagattacggtttaggggattatggcaagctctctgctgtgttcagggagattcctttctaccatggaggattgcattctgtgttctatgttatattcagaatgggaaagattctttgggacaagacactaattcactgaaatgtgatttaggcatcctcagctgtctgttttttgtgattggaaacagaacttacaaaccaatgaagaaataccaaattaacttccagaaatcatgtaatttttaagaaaccccatattcccatccctaatttttttctctttcgttaaaaaacggaataattccctattgcttctttctttgggttttcacatttctagccaggtcctgaaatggattggagagaccacagtctccaaagttgttattccaatattccaacgaattctcagttgggagaatggaacctctggcattcttcccagaaagccagcttggtttcttcgtggaaagtatagcatagcctaggaactgaggaggctggaattctgatcttgtcctagcttctgaccttggacaaagcactcagcatctttgttcttcaataatataatgatgggttaggaggtgcagtcacttctgtaggcttcaagaggctactgaaatatcaatggcagctttgcagtgttctctgagatgcttgaagaggatgatgggcaaatataaaatgtttgttggatgtgtatagtgtctttgccattttagaaggttccagtgagctgcgttttagggagctattggggttgctctggtcttttttgaaagtacagagaagcttaaatatatagagttgcaaggactctttggagtcagtcattttcctcatctagctgaaaaatctgaacgctgagcggtggcatgacttgcccgtggttgtgcagctggttgggcagagctggcattagaacacagctgtccttacttccaggctgggtgccgtaactcacgcctgtaatcccagcacttaggaagaccgaggtgggcagatcacttgaggtcgggggtttgcgaccagcctggtcaacatagtggaccccagactttactaaaaatacaaaaattagtcaggcatggtggcacatgcctgtaatcccagctacttgggaggctgaggcaggaaaatcgcttgaacccaggaggcacagattgcagtgagccaagatcacgccactgcactccagcctgggtgacagagacagtgagactctgtctc

SEQ ID NO: 6196 - DNA, 1017 bp, Homo sapiens
  ENST00000535548
atggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaactggactttggctcacgtggttactcaaggccttttggggaaagaaaaggattgaaacaattccgtttttatagagaaagagcatgtgtggcctgttcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaa
